United States Patent 10,750,711 (STREPTOMYCES ENDOPHYTE COMPOSITIONS AND METHODS FOR IMPROVED AGRONOMIC TRAITS IN PLANTS) - sequence listing, part 3

SEQ ID NO: 4440 - DNA, 3492 bp, Glycine max var. Williams 82
atggcaaatgatggtacagtgtctgaaacaaagtgtacccatgacgtattccttagttttaggagagatgatacccatcacacttttacttgtaaactctatgattctttgtgccggaagggaattatcaccttcatggacaatgaggagctcaaagttggagatcaaattggtcataagcttctaaaagccattgaagaatcaaggatctcgattgttgttttgtctgaaaattatgcagcctcttcatggtgccttgatgaacttgtgaagatccacgagtgtatgaaggcaaaaaacctgctcgtttggcccatcttctacaaagtggatccctcagatgtgaggcaccagaatggaagttatggtgaggccatgactgagcatgaaacacggtttgggaaagactcagagaaggtgcacaaatggaggttaaccttgactgacatgaccaacttgaaaggagaacatgtgcaagaagggagggacgaatccaagtttatcgatgatcttgttagcaggattttcattaaggtgtctcctaaagatttatctaggaatgagcatatagttggatgggagtatcgagttgaagaattaaagtcacttctagaacttgagtctcataatatcactaattgtctgctagggattcatggaaccggtggaattggcaaaaccacacttgtcaaagctttgtatgactccatttacaaacaatttcagggttcgtgttttctctccaactttagagaaaattcaagtcaaattcagggcataaaacatctgcaagaagggcatctatcagagatacttgagggaagcaaaatcctgttgaaaaatattgaaaaaggaataggaacaataacaagtagacttcgtctcaaaagagttgttatagttgtcgatgatgttgatgacattgaagagttaaaaaagttggctgaggaacttgatcggtttggtcctgggagcaggatcatcataacaacgagaaataaatatttgctagatgttggtcaggtcgaaaaaaaatatgaagtgaagatgctaaacgaccaagagtctttggagctcttttgccagagtgcctttagaaagagttgtcctgaaacaaactatgaagacctgtccaatcgtgcaataaggtgttgcaaaggccttccattggccttaaaagtactaggttctcatatggttggaaaagatttgggtggatggaaggatgcattggatagatatggaaagagtcaacatgaaggtgttcaaaaagttctaagaataagctatgatagcttgcccttcaatgagaagaatatttttcttgacattgcatgcttcttcaacggatggaaattggaatatgtaaaaagtgtactggatgcatgtgacttcagctcaggtgatggtattacaacattagttaataaatcacttttaactgttgacaacgagtgcttggggatgcatgacctaatacaagaaatgggtagagagattgttaaggaggaagcaggtgatgtagttggtgaatgcagcagattatggcatcatgaagatgtttttcaagtactagttaatgatactggaagtagcaaaattcagggaataatgcttgatccccctctaagagaagaaattgaatgtactgatattgtatttaagaagatgaagaatcttaggattctcattgttcgccaaacaatattttcatgtgagccttgttatctcccaaataacttaagggtactagaatggacagagtacccttcacagtctttcccgtcagatttttatcccagtaaacttgtgaggttcaatttatctggaagcaatctactcgtactggaaaatccatttcagagatttgagcatttgacttacatggaaatctcccattgtcgtacggttgttgaatttcctgatgtctctcgggccaagaatttaagagaattaagacttgatagatgccagaaactggttagcattcataaatcagttggacgtcttgctaaccttgtttttctaagtgctacacactgcaatcaactccaaagttttgttccaacaatctatttgccatctctcgaatacctttcctttggctattgctcaagactcgcacacttcccagagattgagagaacaatggataagccattaaggattcaaatgttatatacagctatccaggagcttccagaatccattaagaaacttactgggcttaactatcttcacattgaaggttgtaagggactccaacatttaccaagtagcttatttgtgttgccaaattttgtcacattaagaattggaggttgttatctacttcgagagtcatttagaaggttcgaaggaagccattcagcttgcccaaaactagagacattacacttcggtatggctgatctatcagacgaagatattcacgcgattatttacaattttccaaacttgaaacacttagatgtatcgttcaaccattttgtgtctctcccagcacacattaaacaatctactaagttgacaagtcttgacgtgagttattgtgataagcttcaagaaattccagaacttccatcaactgttcagaaagtatatgcaagcgaatgcaactccttaactcccgaaacatcaaacatcttatggtctcaggtgcgtaaagagattaggggattagaagtgaggatgccgaaaagggagattccagaatggttcgactatgttaatgagggagggtatccagttttcaaggctcgtgggaagttccctgcagttgctttagcgtttgtattcggggacgtgaaggcccttccttatctctcgtcgatgggagttcacttgcacttgttcattgagggtgaacacagactgtgcgatagattcatagtggtcaagaatcaagcgttgttgtgtgacatacgagttttgttcagtttcgagaagtgggaggatgtaggtgttggaattggtaatgattggaagaccatacaggttttctgtgaaacaggctgcaactctctacgttcatggggagtttatgtgtacaggcatgagactaacatggaggatatccaattcttgagtcaacattctatttcctctttggtgaggagtcttcacgaagaacgtaagaaatcagaccaaagtttgaaagggcgagagatgtttcatttgcaaatgagaaataatgaagagatgttttattgcatgcataagcaaagaaggcgagagttgctgctaatctcagaaaaaacatcaaggagggctatggctccaagagagggggaaggtagttcagggttgaacatcgatgacaaggaggacaaggaggctgattcaatgttggagttgttagcagagattacaagtgatgatggagaagagactcaagaagctggtccttcaagcgaacaacgatatgaaggacttctggatgaagattcaagatcagcatgcaggtctggaaaaaagctcagaagatgttga

SEQ ID NO: 4441 - DNA, 1014 bp, Glycine max var. Williams 82
atggcttccattggcaaaaagcagcacattttagctcttgtgctccttctctcaatctgcacttcccaagtaatgtcccgctacctccatgaggcatccatgtccgaaagacatgagcagtggatgaaaaaatatggaaaagtatataaggatgctgctgagaagcaaaaacgtttactgatattcaaggacaatgttgaattcattgaatccttcaatgctgccgggaacaaaccttacaagcttggcatcaatcaccttgctgaccaaacaaatgaggaatttgtggcttcccataatggatacaaacacaaggcatcacattcacaaacaccattcaagtatgaaaacgttactggtgttcctaatgcagtggattggagggaaaatggagctgtcacagcagtcaaggaccaaggccaatgtggtagctgctgggcattttcaacggttgcggcaacagaaggtatctaccaaataactacaagtatgttaatgtccctttcagagcaagagttagtggattgcgacagcgtggatcatggttgtgatggaggttacatggaaggtgggtttgagttcattataaaaaatggtggaatcagcagtgaggcaaactacccctacacagcagttgatggaacttgtgacgcaaacaaagaggcttctcctgcagctcaaataaagggatatgaaacagtgcctgctaacagtgaggatgcactgcagaaagctgttgcaaaccaacccgtgtcagttaccattgatgccggaggatccgctttccagttctactcaagtggggttttcacaggacaatgtgggactcaactagaccatggcgttacagcagttggttatggtagcactgatgatggcactcagtattggatagtgaagaattcatggggcacacaatggggtgaagaaggttacataagaatgcaacgaggcacagatgcccaagaaggcctatgtggcattgccatggatgcctcgtacccaactgcttag

SEQ ID NO: 4442 - DNA, 2379 bp, Glycine max var. Williams 82
atggaaattgatctgaaccatgaagtgactgaggctgagaagaatgcattctgtgatagggaatgtgagaaaggtgctggtgctggtgctggtattacttgttggtcctcttccacttgttcgtcctcttcagcagcttgtgtgtcctcttcttaccttgagctttggcatgcttgtgctggccctctcacttctcttctcaagaaaggaaatgtggttgtctattttccacaaggtcacttagaacaggttgcatctttctctcctttcacaccgttggagattcccacctatgatcttcagccacagatcttttgcagggttgtcaatgtccaactacttgccaacaaggagaatgatgaggtttatacacaggttactttgcttcctcagccggagttggaagggatgtattcagagggcaaagaactcgaggaattgggagcagaagaggatggagatgaaagatcaccaactaaatcaacccctcacatgttctgcaaaacactaactgcctctgataccagcacacatgggggcttttctgttcctcgtagagctgctgaagactgttttcctcctttggactataagcagcagaggccatcacaagagcttgttgccaaagacctgcatggtgtggagtggaaatttcgtcacatttacagaggtcagccaaggcggcatctactcactactggctggagcatttttgtaagccaaaagaatcttgtctctggtgatgcagtgctcttcctaaggggtgaaaatggtgaactgagattgggaatcagaagagctgttagacctagaaatgatcttcctgaatcggttatcggtagccagaactgctattccaatgtcctttcttctgtggcaaatgcaatatccaccaaaagcaagtttcatgttttctacagtccaagagcaagtcacgcagactttgttgttccctaccaaaagtatgttaaaagcatcaagaatccagtgagcattggaacaagatttaaaatgagatttgaaatggacgaatctcaagagagaaggtgtagtagtgggacgttgattgcaacgagtgatttggatccttatagatgggccaaatcaaaatggaggtgtttgatggtcagatgggatgaggatattgaaactaatcatcaagaccgagtatctccatgggagattgatccttctgctcctctgccccccttgagcattcagtcttctccaagactgaagaaactgcggacaggtctacaggttgcctcacctagtcacctcatcactgcagcacgaggcagtggattggtaggctttgaggagtctgtaagatcacccaaggtcttgcaaggtcaagaaaatgcaggttttgtgtcattctactacggatgcgacacagtaaccaagccaccaggttttgagatgagctctccgagtcatccaaatcttggatcagctgaagtaagaaaggtttcctcttctgagctgaatagtgtccaccctttcagttatgcaggctttgtggaaactaacaggtttccgagggtcttgcaaggtcaagaaatatgttcattgaaatccctgacaggaaaggttgatttgaaccttggtgcttggggaatgcccaatctaagttgcacaactttcaacctccaccaggcaaccaaaccaaactttcaaccttcattgtttccttacggggatattcaccaagccggtcaagctagcttgttttgctcaaaatccaccactttccagagagaaaatgtcccatttaacaagccatccactcaggcagggatcattgtaaatgaagttggaagatcagatctcccaaatgagcataagctgcaggacaatatttcttctgctgcaaatatgggggtttctaatgacaacaatgtccagggaaaggtaaatgcctgcaaactattcgggttttctttgtctggggaaactactgcccaaaatttacagaactctgctaaaaggagctgcaccaaggttcataagcaaggcagcttagttggaagagctattgatctttcaagacttagcggctacaatgatctgctaagtgaactagagagactgtttagcatggaaggccttctaaaagatcctgataagggatggaggattctctacactgacagtgagaatgacataatggttgtgggggatgatccttggcatgagttttgtgatgtggtgtccaagatccacatatacacccaagaagaagtggaaaagatgacaattgggatgatcagtgatgatactcatagctgtttggaagaggcaccagtgattatggaggcttcaaagtcttcctcggtgggtcagccagattattctccaacggctgttagagtctaa

SEQ ID NO: 4443 - DNA, 1014 bp, Glycine max var. Williams 82; identical to SEQ ID NO: 2308

SEQ ID NO: 4444 - DNA, 2241 bp, Glycine max var. Williams 82
atggccaaccaaaactctctgcccctctatgagaaattctggtacaagcacaattacaaaagggtaacggaaagcttgctttcagtcctcctcttatggttgcttggttaccgtgttatctctatcaacaactactctttcccttggtttgttgcctttttatgtgagtcgtggttcaccatctcttggtttttagccctaaccactcaatggagtccagcagtaaccaaaacctacccagatcgtctcttgcaaagtgtgcaagagcttccgccagtggacttgtttgtgacaacagcagatcctgaacttgaaccaccgattatcacagtgaacactgtgttatctctgttggcacttgattacccagctcacaagctagcttgttatgtttctgatgatggttgctcccctcttaccttctacgctcttcaggaagcctctaaatttgcaaaattttgggtacctttttgtaagaagtacgaagtccaagttagagctccactcagatatttctttgacaaacctgaggtctctacagccaacaacacgccaaagttcaaacaagaatggttaaaaatgaaggatatgtatgatcaacttagccgcaaaatagacttggattcttttacaaaatcaaatccatgtcttggagaatttgcgactttctcaaacactgagaggacaaaccatccgtccataattcaggttatatgggagaacaatgaaagccttgcagatggattgcctcatttaatctacatatctagagagaagaggccaaaacagccccatcatttcaaagccggtgccatgaatgtgttgacaagagtttctgggttgataaccaacgctccctttatgttgaacgtggattgtgacatgattgtaagtaatccaaagattgttctgcatgcgttgagcattttgcttgatcccaagggagaaaaagaagttgcgtttgttcaatgtccccaacaattctatgctacattgaaggacgatccttttgggaaccagatgacaattttgttcaagaacttggcgcccggattagctggactgcaaggacctttctacgggggaacaaactgcttccatagaagaaaagttatttatggtcgttctccggataacattgaaaagggaagcggcatatcagacgaggaattcaaagaaaaatttggggcttcaaaggattttctgaaatcagctgcttttgctttgaaagggaggatatattcgcctaatgatattaatatttcgaatgttgttgacgtagcaagccaagttgccggttgtggatatgaatatggcacaggatggggcaaacaggtgggttggatatatggatcaataacagaagacgtactcaccgggctgaccatacatgagaaaggttggagatcagaattgtgtacaccaagcccaattcccttcactggttttgctccaggaggtggcccaacttcaatggcccagcaaaagagatgggccacaggaatgcttgaaatcttcatatgcaagcattgtcctattatttcttcccttttccgtaagcttactttgaggcagtgcttagcatatatgtggattatcaattggggtctgcaaccagtctttgaagtatgttatgcatgtctccttgcatattgcatcatcaccaactccaatttcttgccccaggacctaggaatacgtatccctattgcattttttgcaatttacaaggtatatactgtatgcgaatatttggcagcagggttatcagttcgagagtggtggaacaatcaaaggatgtcaagaataacatccatgaatgctggtttttgtgcatttcttagtgtcctactcaagttgttaagaatatctgaaactgtgtttgacgtaacaaagaaagacttacccccaacaggaaatgttctagatgataaggatgctggaaggtacaccttcgatgagtccgtagttttcttgccaggcactaccattttgttgttgcaattgacagcaatggttatcaagttattagggttgcaaccaccagtgccaactccgagtaggaatggaagtggactaggtgagattttctgtagtgtttatttgatgatttgctattggccatttctgagaggattatttgagacaggaaagtataggattcccatgtccacaatatgcaaagcagctatattgacatgtctctttgtacacctatgtagaaggatcattactagttga

SEQ ID NO: 4445 - DNA, 939 bp, Glycine max var. Williams 82; identical to SEQ ID NO: 2263

SEQ ID NO: 4446 - DNA, 1032 bp, Glycine max var. Williams 82
atggaccacaccgaagctcacttgccacctggttttcggttccacccaactgatgaggagctcataacttactaccttctcaagaaggttcttgacagcaccttcactggtagagccatagctgaagttgatctcaacaagagtgagccatgggagctccctgagaaagctaagatgggagagaaagagtggtacttcttcagcttacgtgacagaaagtacccaactgggttaagaaccaatagggctactgaagctgggtactggaaagccacagggaaagatagagagatttacagctccaaaacttgttctttggtggggatgaagaaaaccttggttttctaccgtggtagagctccaaagggagagaaaagcaactgggtcatgcatgagtatcgccttgaaggcaaatttgcttaccactacctttctcgcaactccgaggatgagtgggtcatatcacgtgtgtttcggaagagtaacaccacaccgatcaccaatggaggctccaccatgtccgcttctactaactccaagaagacaagaattaacaacaccacctctcttatccatgaaccaggttcaccctcttcagttttccttccacctcttctagactcttctccctacaccaacaccaccaccaacaccttcaccgaccatcacaatagttcttatgatagtgccaccaaaaaggagcacgtgtcctgtttctccacaatagctgcagcaacagctgttgtctcccccaacaacaacttcaacaatgcaagcttcgaccttccaccttctcagcctcttgcaaccgacccttttgcaaggtttcagagaaacgttggtctttctgcttttccaagtttgaggtctctacaagacaaccttcagctacctttcttcttctccacggcggcggcgcctcccttctccggcggaggctccggcgacttcctcagctggccagtgccggaggatggtgtttccaacatgccactgggcgtgtcggagcttgattgcatgtggggctactaa

SEQ ID NO: 4447 - DNA, 1080 bp, Glycine max var. Williams 82
atggaagagatcaacacgaaaccattggccacttctcttctggtgccatcagtgcaagagttggctaaacagaatttctctagcgttccacaaagatacattcaacatcaacatgaagacatggtgctcatctgtgaagaaactaacagtacgagtagccttgagattccagtaattgacatgcacaacttgctttctatagaagctgagaattcagaattggacaagcttcaccttgcttgcaaagaatggggattcttccagcttataaaccatggagtaagcccttccttgctgaagaaactgaagttggagattcaggacttcttcaaccttccaatgtcagagaagaaaaagttttggcagactccacaacatattgagggatttggacaagcatatgtagtgagtgaagaccagaaacttgattggggcgatatgttctatatgacaacccttccaactcactcgagaattccccacttatttccacaactccctcttcctttcagagacactctagagctttactcatgcaacatgaaaaatatagccatggctattattggccagatgggaaaagctttgaagatagaagaaatggaaataagagaattatttgaagatgagatacaaaagatgaggatgaactattaccctccgtgtccacaaccagagaaggttattggcctcacaaaccattcagatggagtaggtctcactatcctcctacatgtcaacgaagtagaagggctccagataaagaaagatggtgtgtgggttcctattaagcccctacctaatgccttcgttgtcaacattggagaaatacttgagattgtaaccaatgggatataccaaagtattgagcacagagcaacagtgaactctgaaatagaaaggctttcaattgcaacattccacagccctgaactagatgtggtggtaggtcctgtggctagcttaatcactgaacaaacaccagcacggttcaaaagaattaaaatggaggactacttcaggggtcgatttgctcgtaaacttgatggaaagtgttacttagataccataagaatttaa

SEQ ID NO: 4448 - DNA, 522 bp, Glycine max var. Williams 82; identical to SEQ ID NO: 2328

SEQ ID NO: 4449 - DNA, 639 bp, Glycine max var. Williams 82
atgtctaaatattcctctaccttgaaacttctctatttggttatcctatcagcttttgccatcgtgcaagtaacaatggccagcgacccagacattctcattgactacaaactaagggaatgggtgataattctctcctctttcattcttttagatgaatacaacaacccagataggaaattcttcaccttcacgggctttcatgtcctcgttggtcaaaacccttcaccctcaacctttaaggtgtcgaaagcgagcatggtagagtttcctgctctgaatggacaaagtgtgtcttatgctgtccttcagttcccaggtgggaatgtcaacccaccccacactcaccctcgttcttctgaagtagggtttgtcgacacaaccaccaacaagctctgcacgcagagccttcaaatcggggatgtgttagttttccccagtggtcttgcccacttccaacacaatgtcgatgcaaagaatcctgctcttgctatttcggcctttggtagtgctaatgctggcacggtttctcttcctaacacgttttttaacacgtctattgatgacactgtcttggctttggccttcaagaccgatgttgccaccattcgaaatttgaagaaaggtttggcttcctag

SEQ ID NO: 4450 - DNA, 438 bp, Glycine max var. Williams 82
atggattcccccaaggatcatcaaaatgttgtaaccatagatgtccatgctgccaaagatctgctcaattcatctggttatcgttatctggatgttaggtcagttgaggaattcaacaaaagccatgttgagaatgctcataatgtcccctatgtcttcatcacagaagcaggacgggtgaaaaatccagattttgttgaccaggtggcagcaatatgcaagactgaggatcatttgattgtggcttgcaatagtggaggaagatcactccgagcctccgttgatctgcttgattcaggatttaagaatattgttaacatggggggaggctactctgcgtgggtggatgctggatttgccgggaacaagccaggagaagacctcaaaactagctgcaagttccgtcctaacatcgcaaaacccactgcacaaccatag

SEQ ID NO: 4451 - DNA, 975 bp, Glycine max var. Williams 82
atgggtagccagagttgcttcaaggctttgattatttgccttatagcattaattggatcaactcaagctcaattgcagcttggtttctatgccaaaagttgtccaaaggccgagaaaataattttgaagtatgttgtagagcatatccgcaatgctccatcactagcagctgctctcataagaatgcacttccatgattgttttgtcaatggttgtgatggatcagtgcttgtggactcaacaccaggcaatcaagctgaaaaggactctattccaaatcttacactccgaggctttggtttcattgacgcaataaagaggcttgttgaagctgaatgccctggggtagtctcttgtgctgatatcttggccttgaccgccagagactctattcatgccactggtggaccctattggaatgttccaacaggacgaagggatgggctcatctctagagcagcagatccgttacgcagcctgcctgctccatttcacaacctcactacccaactaacactctttggcaatgttggacttgatgcaaacgaccttgtcttgcttgttggtgctcacacaattggtgttgcccattgttcatcaattgcaactcgtctatacaatttcactggcaagggtgacatagacccaacactagacagtgaatatgcaaaaaatatcaaaacttttaagtgtaagaacatcaatgataatacaattattgagatggatcctggaagtcgcgatacatttgatcttggattttataaacaagttgttaagagaaggggcttgtttcagtcagatgctgaatttcttactagtcctatcacaaggtctattatcgatagacaacttcaatcaactcaaggattctttgaggaatttgccaagtctatcgagaaaatgggacgaattaatgtcaagcttggaactgaaggggagataaggaaacattgtgcacgagttaataactaa

SEQ ID NO: 4452 - DNA, 900 bp, Glycine max var. Williams 82
atggcttcttttgggaaccaactctctttctttttgctcttggtgcttgtcatctccccccaaattcaagctagagaaggcaagctctttagcttgttctcccatttcagaaccatctataatgtcagagaccctcttgacaaaacaaaagctgaatctccagcactagcaccagaaccagctctagaaccagcatcagcagcaccaacaccagaaccagaaacagcaccaacaccagcaccttcagctgaacaagaaattgggtcaacaataccatctggaccagcaccagagcctgaattttttgacagtggagaggcttatggcctctatggtagaggctcttatagccaataccctcccaccaaggagactcctaccgccaccaccacctttcaaaatgcgcttctgaatgaagacgtcaatgaggagagctacaaaactggctaccccaaatccaatttctacaacaacaacaatgaagagtacaacaacaatcacaacactagggaagagtacaggaacagttacattggtggctactccaacaacaactacaacgaaaaggaaaattactacaacaacaacaacaactacaatggcaaggaaaattactactactacaacaacaacaacaacaataacaacaacaacaactataacggcaatggctatgaggagaagagagagggaatgagtgacacaaggtccttggagaatagaaattactactatcatgtgaatagtgttaatgagaattataaccttaatgggtacgaatcagggagagggaggactactgaaaacgaaggttactatgagaagagtcagtatccaaatgagtttgacaccatggaagagtacgagaagcagcaggaagaacaaggctacaccccttga

SEQ ID NO: 4453 - DNA, 804 bp, Glycine max var. Williams 82
atgcagctccaccgtgtctccgccgcatcgaaactgagcctcacgtgcttcagcttcgccttgaaattcgtgctgttgtacgctgcggaggcacagcttcagcaccgcggccccgacctacattggtaccccggaaccgccacctggtacggcgaccccgaaggagacggcagcaccggtggggcatgtgggtatggaacaatggtggatgtgaaaccattcagggctcgagtgggggcagtggggcccttgctgttcatgaagggggaagggtgtggtgcgtgctacaaggtgaagtgtttggacaagagcatttgttcgagaagagcagtgacagtgataattacggatgagtgccccggttgcccctctgaccaaacacactttgatctcagtggtgccgcgtttggtcgcatggctattgctggcgagaatggtccactcagagaccgtggtcaaatccccgtcatttaccgcagaacgctgtgtaaatatcctggaagaaaaattgcatttcatgttaacgaaggctccacaccattttggctatcacttctggttgagtttgaggatgcagagggagatattggctccatgcatatacgagaagcagggtctactgagtggctacaaatgaaccacctttggggtgcaaattggtgcattattggaggacctttaagaggaccattctcagtgaaattgagctcctccactgggagaagcctctctgcaagagatgttattccaactaattgggttccaaaggccacttacacctctcgcctaaatttctacccctaa

SEQ ID NO: 4454 - DNA, 186 bp, Glycine max var. Williams 82
atgaagggagatatggaagcgaagctgagagagtttgagaagatttatactctcacaaccacggagaagcgtaaaaccgacctcctcagcaaagcaagccttgagtgtcttttggcattgtgtgtccataggaattacttgaaggcacttcttgatgcaatgggaggaaactacgccaatgtatag

SEQ ID NO: 4455 - DNA, 2259 bp, Glycine max var. Williams 82
atgacttcatcgcgggatgatacaaaagttgtgctagttgcttggtttctattaatgatctcagcaatgtcacaaacaattcattccagctgccaaaataaatgtggaagtgttaacattccttacccatttggtacagctgaggactgctacttgaacagcaacttttatgttgcgtgtaacacaagtcacaaccctcccaaaccatttctgtggaatgtcaccaaaagtattgagatcttagaggtttcattgaatggccatttgaggataaaatcccctgtagcttatgtgtgctatgatgaaaagggtgtgctagtggattcagggaattcatctatgactttgcaagcattccccttctcatacacccagaacaagttcattggaattggatgtgacaccctttcaagcatcaatgcaacaattgggaaaaactactcagctggagggtgtttttcactttgtagtagtgtagaaagttcagccaatggttcctggtttggcgttggtttctgccaaacctctatcccaaaaaacatcttggcatatcaagctcgtgtgctgagtttaaatttgatgcatagggatatgaatattccttgtagctactctcttttggtggaagaagactctttcaagttctccactgatgacttcatcaaacttcagaagagaaaaaccgctcccacagtgctagattgggctgttgggaatcaaacatgccaagaagctaagaagaatttgactagttttgcctgccaagaaaatagcaagtgtattgactctgacaatggaccagggtacctttgcagatgcttagaaggttatgtgggaaatgcataccttcatggtggatgccaagatattgatgagtgtgccaatctgagtctaaatgactgttcagatctttgcattaatctacctgggagctataattgttcttgtcctaagagcaaggggtaccagggagatggcagaaaaggaggaagtggctgcgtctcgaatctacaacatgtggttaatcagattgtgataggcactggcataggccttatgctgttgttaattggtagtggctggctataccatgtgtttcgtaaaagaaaaagagtgagactcacaacaagatatttcaagcaaaatggtggcttaatgttacagcagcaaatttcaaacatggaaggatcatctgagagagccaaaattttcactgcaagagagctaaagaaagccaccgaaaactttcacgagagcagaatcattggcagaggaggatacggtacagtttataggggaatacttccagatgaccatgttgttgctatcaagaaatcaaaactagtagaccacagccaaaccgaacaattcatcaatgaagtggttgtactgtcccaaattaaccacagaaatgttgtcaaactcctaggttgctgtctggagacagaaatgccacttctggtttatgaatttgtgaacaatggcaccctctttgaccacattcacaacaaaaacaccacacttccttgggaagcacgtctaagaatagcagcagaaacagctggtgtgcttgcatacttgcattctgctgcctccataccaatcatccatagggacttcaagtcaactaacatactcttagatgacaaatacacagctaaggtttctgactttggaacctcgagattggttccacgtgacaagtgtcaattgacaacgttggttcaaggaactctagggtaccttgaccctgagtactttcagagcagccaactaaccgagaaaagcgatgtttatagctttggtgtcgtgcttgcagagttgctaaccggaagaagggcactttcttttgacatgccagaggaggagagaaacttagccttgtatttcctttcagctgtgaaggatgattgcttgttcgaaattgttgaggattgtgtgagtgagggaaatagtgagcaagtaaaggaagttgctaacattgctcaatggtgcttgaggcttagaggggaggaaagacctaccatgaaagaagtggcaatggaattggatagtcttagaatgatgacaacaacaacaactacatggattaatgctacatcaaattcaacagaatatgtgattggtgaaaggtcaggtctaagtctaacagaaacaacagactatgctaattgtcattatacttgtaatacatgtgctgggcatgaggatgaaaccatttgcaacgatgtgatgtcaccgatatgggatggtcgatga

SEQ ID NO: 4456 - DNA, 2229 bp, Glycine max var. Williams 82
atgcaattgggttttctgcaaaatggattggatttatctccaggaaaaagtctggatggaagtttcaggaagtctagctctgttatttctgctagtactgtctctgggacctcaggattgagccagtttcttcctatttccagaagagtattaaaggggctcaaggaatatggaaggaaactggttgacctggagttattcagtcaatatcttgaggagtgggtcttggagaatctaaatggtgattcagaagatgggatgcaaagttttcgttctcccttcacaactgatgaattgtgcaaacttgatttggcattggagggggtaccatttcagcaactcgtccgtatgccattctttgctgacgtttctgatgagcttatagaagatcagtatctagctgcagaagatttccttcatgctattataattggactttggcgtacgttttggcataaaagtggaccactgccattatgtgtctcttgcccctctcatattggttcgaggttcagtagtgttgaaaaggcaatatcaaggggaagactgagggaaatgcgtggtttaggtttaatatcaaaaattgctactgattcaaaatttaaatgggatcatatggtagagtttgccttattcaagccagaagtattcttggacaatgattcaagactatcagccagcactatttgtgaagctctcttttatggtttccatgttcttgtttctcggagtttgagcaagattagttctgtcaacagtgattctgttttccttctagttctagattctaaatgtggagtagtgataaagttcagtggtgaccttgggaaacttgatttattgaattcaagtgatccatatctatctgttgctgaatggatcaaaactaatgctgaaatttgtgtcaccccagtggaaccaatatggaaccgattaggaaatccaaattggggagatataggaactctacaggtactattggcaactttctactccattgcacaatggaatggacctccgcgaaaatcagtagcctcattgatttcagatcatagtctccgccttcagaagcggagaacagaatgctgcatcattgagactgaaaatgcattggtgccttatcatgagacatctgaccatcaagcaggagaaattgttgagcttgatcaaaatgaattattttcccataaccgagcttcacgtttgaagctcaagtgtggtgacatattggccttggatgatccacagcagggacagaaaagtttccaaattcatgaatctctggtaggagggaagtattatctctatagtgcagtttgtcttgatcatccctcggagttattgactttatatgtgggtgctcatccatctagacttgagccttctttggaggatatgagcctttggtaccaagtgcaacgccaaacaaaagttctaaacattttgaggaatcagggaatcttgagcaaatacttacctgaaattgttgcctctggtaggattttacattctggaccttgcaagaaagagagccccgggggaaggtgtgatcacccttggtgtgggactccaatactggtgatatctccaataggggagccgctatcatctgtggttgctaatgaggggtcattttctgcagatgaagcaacgcgcttgtgccgggattgtctagctgctctaagaagcgcagccatggctaatgtccagcatggtgatatttgtccggagaacatactacgtgttgttgaaaaacaaggtgtgagaaaccaaactatgtatgtccccatatcttgggggcgtggtgtgttggaagacagggacagccctgccataaatttgcagttctcatcatctcatgcacttcagcatgggaagctgtgtccttcttccgatgctgaaagcattgtgtacatcctctattttatttgtggagggactatgtctcttcaagattctattgagtctgctttgcaatggagagaaagaagttgggcgaagcgatcgatccagcaacatattggtcaggtttctgctctcttgaaagcatttgctgattatgtggatagcctttgtggaactccataccctattgactatgatatatggttgaaaaggttgaacaaggctgtggaaggctcagcagataaaggtaaaatgatcgaagaagtacctataacattaagattagaggatgctgcggagtcttcaggagcttctggcccttga

SEQ ID NO: 4457 - DNA, 804 bp, Glycine max var. Williams 82; identical to SEQ ID NO: 1316

SEQ ID NO: 4458 - DNA, 1278 bp, Glycine max var. Williams 82
atggaaagtggggttgtggctgtgaacaacaacatcaacaactatgaatccaaggcaacttccaccatcaccattaagggcattctcagccttctaatggaaagcattgatgatgagaattgtgatggtggtggaagcaagaagagagttatttctcttggtatgggtgacccaactctcaccacattgttccacacaccaaaggttgttgaagaggctgtcgctgatgctcttcaatctcgcaagtttcatggctatgctcccactgctggacttctccaggctagaattgcaattgctgaatatctatctcgtgaccttccttatcaattatcacgagatgatgtcttcatcacttgtggatgcacacaagccattgatgtttcggtggcgatgcttgctcgccctggtgcaaacatcttgcttccaaggccaggcttcccaatctatgaactttgtgctgcatttagaggggttgaagtgaggcattatgatctgcttccagagaaaggttgggaggttgatctagatgctgttgaagctcttgctgatcagaacacagtggcgttggcgatcataaaccctgggaatccttgtgggaatgtgtacagttaccaccatttggagaagattgctgaaactgcaaaacgggttggaacaattgtgatctctgatgaagtttatggtcaccttgcatttgggagcaagccttttgtaccgatgggagtttttggctctactgttcctgttctcactcttggctcactttctaagagatggatagttcctgggtggaggcttggttggtttgtgacaaatgatccatctggcacttttagagaaccaaaggtagtcgagcgtatcaaaaagtattttgatcttctaggaggtccagcaaccttcttgcaggctgctgtacctcagataattgcaaataccgaagaaattttcttcgagaaaaccattgataatttgaggcatacagcagatatatgttgtaaagagatagaggatattccctgcattttttgcccttacaaaccagaaggatccatggctatgatggtgaaattaaacctttcacttctggaagatattagtgatgatattgacttctgtttcaaacttgcaaaggaggaatctgtgatcattcttccaggaactgcagtaggcctaaaagattggcttcgtattactttcgctgctgatccatctgctcttggagagggtatgagaaggataaaatctttctatcaaaggcatgcaagaaaattgtaa

SEQ ID NO: 4459 - DNA, 1194 bp, Glycine max var. Williams 82
atgaggacatatgatgtgtttgtgagcttccggggtgaagacactcccaacaacttcactggttttctttttaatgctcttcgaaaaaaaggcattgatgccttcagagatgatacagatatcaagaaaggcgaatccatagcacctgagctgctacaagcgatcgaaggctctcgcattttcgttgttgtcttctcaaagagctatgcttcctcaacatggtgcttgtgtgaactagcaaagatctgcaagtacattgacacatcagaaagacatgttctgcctgttttttatgatgttgatccatcagaggtgggaaaacaaagtggatattatgagaaggcctttgctgaacatgaagaaacatttggagaagataaagagaagatagaagaagtaccaggatggagagaagctctaacaagagtcacaaatctctctggctgggatattggaaataagccacaatatgcgaaggttgaagaaattgttaaaaagataacaaatatattgggtctcaaattttcaagtcttccaaatgctcttctagttgggatgaaatctcctgttgaagaattaacaaagcttttacgttttgagtcagttaatgatgttcaacttgttggaattagtgggataggtggaataggaaagacaacacttgcccgagctttgtacaagagaatcactcatcaatataattttcgttgttttattgatgatgttgaacaactaaagctatttatagggagtagagagactctattacatgaatgcctaggtggaggaagcataatcatcataatttctagggataaacaaatattatggacatgtgatgtttaccatgtcaatccattgaatgacaatgaagctgttcaattgttttacaaaaatgctttcagagctaattatattatgagtgattataaggagttgacgcatgatgtactattcaatgctcaaggccatcccttagcaattgaagtattaggctcatctttgtttggtcaaaatcaacatgcgaaggaaattctagattttggtggattttgttttgagtatggccttggaattctcattgataaatcactcataactattcatgaaggggtgattcgtatgcatgacttgttgaaagatttggacagatgtattgttcgagaaaaatcacccaaggagccaataaagtag

SEQ ID NO: 4460 - DNA, 1830 bp, Glycine max var. Williams 82
atgccaccaacagagtcatctacttttgagtctgagagggaacctgtgagatatgtgcacacagtttcagagtcaggtcgacttcttccttcagcgagccgctggaactccatagcactagactttaaacttgctcctaattcttccaccgcctatgaatctatcccttcacaatatccaaaatctgttgacttcaatcttgctatcactgacaggaagcactttcatatttttatttttgttttggtagcaataatttttgccatcttggcagctgttctgctggcacactttttacctcagaagcacaagcatcaagggtcttcaatcaatctcaaactggcaataaaccaggctctaacgttttatgatgctcaaaaatctggacactatccaaggaacagtccagtgaaatttagaggagattcaggattacaggatgggaatttggctaagactgatcttactggtggattttatgattctggcaacaacattaagtttaccttcaccacagcttatactatgaccttgttgagttggactgttattgaatatcatagtaaatatgctgatattggtgagcttgatcatgtgagggacatcatcagatggggtagtgactacctgctcaaggtgttcattcccccaagttcaacagctggatcaaaccttacactgtattcccaggttggaagtaccattagtaataataacaatgagcaaaatgatgtgagttgctggcaacgacctgaagatatgacatatgagagaccagtttcaatttgtgatgcctctgcttcagatttagctggtgaaattgtggcagcattatctgcatcatcgatggtatttgaagaagacaaggattactcaaggagacttatccaagcagcagaaagcctctttgaggcgatcacaagtgaagatcctacagaacacgggacctacaccatggttgatgcatgtggaaaacaagcaagaatgctttataactcaactagctacaaagatgagttggcttggggagcaacttggttatttcttgctactgaaaacgctgattaccttgcaactgcaactgaaatttttttatcagccaagagtgatgaaccaagtgttgacaaaggggttgtttattggaataacaagctcaatgctgtggagattttgcttaccggtattcgattcttccgtgatcctggcttcccacatgaggatgctttgaaactctcatcaaactctaccgatgccctcatgtgttcttatctattcaataaatactttagcaggacacctggtggattgattatcctgaaaccagataatggtccattactccagtatgctgctacagcatcctttctcagtaaattgtacagtgattaccttgatcatctcaaaatgtctggtgcaagttgcaagactgatgcattctcggtggaaatgcttcacgattttgctacttctcaggttagctacatcttggggcaaaaccctatgaaaatgagttatttggtgggctatggtgacaggtttcctctccaggttcatcacagaagtgcatcaatcccttggaataaccaaccctaccgttgtgaagatggtaagaaatggctaaactctaaagatccaaatccacaggttcttttgggagccatggtgggaggaccagacactaatgacaatttcgtggatcaaaggaccaaccaaaagttcactgagccaaacatagcaagcaatgctggcttagttgcagcacttattgcacttcaagatcctccttataattcacgtgacttgaaaaactcattgtggggatggacttga

SEQ ID NO: 4461 - DNA, 1269 bp, Glycine max var. Williams 82
atgagacgtgctcttgctttgcttcctcttctcttcctgtttgtagcgattggggaatcaagaaaagatggaggaaaatattggaaaatgaacacgagagatcatcagatgccgaaaaaatttaaggctctcctcaaccaaaactttgagatccaatctgaaaagattctcaaaaccaaggaacaaattcttgaaggttctaaacatgattgcgaaaaatctctcgttaagaatactcacaccaccatattagaagattttgaaccaatatcaagtgttccaatttacagaaatgatgacatttatgctaaggaagaaaataaagttgtaaaaaactttgaaccaagacctaatgtttcagcttatggtgacaatgatgttgatgctaagccaaagaaaaatgtcatcaaagactttgaaccaagacccaatgtttcagcttatggtgacaatgatgttgatgctaagccaaagaaaaatgtcatgaaagactttgaaccaagacccaatgtttcagcttatggtgacaatgatgttgatgttaagccaaagaaaaatgtcatgaaagattttgaaccaagacccaatgtttcagcttatggtggcaatgatgttgatgctaagccaaagaaaaatgtcatgaaagattttgaaccaagacccaatgtttcagcttatggtggcaatgatgttgatgctaagccaaagaaaagtgtcacgaaagattttgatccaagacccaatgtttcatcttacaatgacaatgacattgaagcagtggaagaaaagaaaatcatgaaagattttgagccaatacctaaagtttcaacttatggtgatgatgatgttaatacaaaggaaaagaaaaaagtcatgaaagattttaaaccaagacctaacgtttcagcttatggtgacaataatgttagtgcaaaagaaaagaaaaaagtcatgaaagattttgaaccaagacctaacgtttcagcttatggtgacaataatgttggtgcagagaaaaagaaaaaaatcatgaaagattttgaaccaagacctaatgtttcagcttatggtggcaacaatgttgatgaagaggcaaaaaagaaagtcacaaaagattttgaatcaagacctaacatttcagcttatggtaacaatggtgttgatgcaaagaaaaaaaagaaagttgtggacaatgacaacattgatgctcagggaaagcctccagaggattttgagcctaggccaaatatctctacttatgatgaatag

SEQ ID NO: 4462 - DNA, 1407 bp, Glycine max var. Williams 82
atgcatggacaccaaccattatatccccccaccgagtcaccaaccatggacgttaagtttggcaccacattaatagttattttctccgtaatgtggctcatgagggtgaatgccattgacccttgtgcctctcaaccggataattcggacctcaacgtgattcccatctacagcaaatgctcaccgttcaaaccacccaaggcagacacatgggacaacagaattataaacatggcctcaaaagacccagtccgagtgaaatacttgtccaccttagtgagtcaaaagacagtctccacggccccaatcgcttcgggccaggccttcaacatcggcaactatgtggtgagggtcaaattgggaacacccggtcaacttttgttcatggtcctcgacaccagcactgacgaggccttcgtaccctgctcgggctgcactggctgctccgacaccactttctcgcccaaagcctcaaccagttacggcccattagactgctccgtcccccagtgcggacaggtccgtgggctttcttgccccgccacgggaaccggcgcgtgctccttcaaccaatcctacgcgggctcatctttctccgccaccctagtccaagacgcattaagattggcaactgatgttatcccctactactccttcggctgcgtcaacgccatcaccggagcctcggtccctgcccaagggcttttgggccttggccgaggcccgttgtccttgctctcccaatccgggtcaaattactcgggcatattctcttactgtctccccagtttcaagtcctactacttctccgggtcgctcaagctggggcccgtgggccagcccaagagcattcgtaccactccgcttcttcgcagcccgcaccgtccttctctttactacgtgaacttcaccgggatcagcgtggggcgcgtcctggtaccctttcccagcgagtatcttgggtttaacccgaacactggatccggaaccataattgattcgggcacggtgataacccggttcgtggagcccgtttacaacgcggtgagggaggagttcaggaagcaggtagggggaactacattcacgagcattggagctttcgacacgtgtttcgtgaaaacctacgaaacgctggcgccgccaattacgctgcacttcgaggggttggacctgaagctgccgttggagaacagcttgattcatagcagcgcgggttcgttggcgtgtcttgcgatggcggcggcacccgacaatgtgaactcggtattgaacgtcattgccaactttcagcaacagaaccttaggattttgtttgatatcgtcaataataaagttggcatagcccgtgagcttgctaggtttggatctttcgttgggttcaaaaaaagtgatgggtgtgggtga

SEQ ID NO: 4463 - DNA, 1794 bp, Glycine max var. Williams 82
atgacccttgtcaattccacgttgcttaattcctctttcatttcaaattttagttttggcaaacctcagaaaccagaagggactaataaccttctcctgcgtagaattatttgccctatccgatgcaacgcaacaaccaccaccacaaacgttaatgcttctgaaagaaaatcagccaattaccagccaaacctctggaattacgattttctgcagtctttgaagtgtgaccatgcggatataagatatgaggacaaggccaagaagctgctagaggaagtgaggagaatgataaaggatgaaaatacagatatatggatcaaacttgaactcattgacgatgtgaaacgcttgggaattggctacagttttgacatggagataggagaagcccttcataggtgcctctcttctgaaacatttattgatacaatcactcataatcacagaagcctgcatgaaactgctttaagcttcagggtcctccgagaatatggctatgatgtcacaacggatatatttgagaggtttaaggactataatggtaatttcaaggcaatccttagcagagatgtgaagggaatgttgagtctatacgaggcatcatttctaagttatgaaggagaacagattttggatgaggctaaggccttcactagcttccatctaaagggtgccctcaaagaaggtagaagcaatactatgatcttagaacaagtgaatcatgcaatggagcttccacttcatcacagaatccaaaggcttgaagcaaggtggtatattgaatcttatgctaaaagaaaagatgcaaatatggtgctgcttgaagcagcaaaactggatttcaatattgtgcagtcaactctgcaaacagatctccaagaaatgtcaaggtggtggaaagggatgggactagcctcaaagttaagcttcagccgagataggctaatggaatgcttcttttggacggttggaatggtctttgagcctcaattgagtgatcttcgcaaaggtttaacaaaagtggcttccttaattactacaattgatgacgtttatgatgtgtatggaaccttggatgaattagaactttttacagcagcagtagaaagttgggatgttaaagcagttcaagttctaccggattacatgaagatatgctttctagcactctacaacactgtcaatgaatttgcttatgatgcacttaaagagcaaggacaaaatattcttccctacctcaccaaagcatggtctaatatgttgaaagcattcctagaagaagctaagtggtcccgggacaaacacgtgccaaaatttgacgattacctcaataatgcatgggtttcagtctctggggttgttatactgacccatgcctatttcttgctaaatcatagcataacaaaggaggcacttcagtccttggaaaattaccatgccttgctgcggagatcatccactatttttcgactttgcaatgatttgggcacttcaaaggccgagttagagagaggtgaggcagcaagttcgattgtgtgttacatgcgtgaaagtggtgctagtgaagagggtgcttacaaacacatccgcagattacttaatgaaacgtggaagaagatgaacaaagataaagtgtcacagtctcctttcccaaaacctttcatagaaatagctatcaaccttggaagaatttctcagtgcacataccaatacggagatgggcatggagctccagatagcacagtcgagaatcgcatacgatccttgataattgaacccattgccatctag

SEQ ID NO: 4464 - DNA, 2673 bp, Glycine max var. Williams 82; identical to SEQ ID NO: 1282

SEQ ID NO: 4465 - DNA, 2172 bp, Glycine max var. Williams 82
atgtcagcacctagtcatgcaattgtaaaggctgtggctgccacagctggggctatgttacttattgctgcgatatttgtttactttttttacaaatttgttcttgctagataccaccagagacacaaagttggtgcaagtttgcttcgagaatcaggagtgaaccttgagtatattaacaaagttggtggcaatgtgaagggactaattgttgaagaaaatggggtggatgttctttatgtgatggacacagaaagaagaccattgattactggttttccaaatagtatattcaatccaagttacgaacttgatgaggaagaaaagagaatagatataatggtccaaaggtccaaagtatccaagcctgaaattccagaggcatgtgaatctcctagtgttgttggtcatgagaatcaagttaagccagtgtcacaagcatcatcaatttcaacatcactaacaccaagacaaaacttgccacaatcacctcaaccactaccacaatcttcaccaatgattgatgagaacaagaaaactcaaccatcaccaccaccaccaccacctcctcctcctcctcctcctcctccaactcgtcctccaccaccaccacctggtccacctccacttcctaaggccagtggcttcatttcatcactgaaacccccacctgctcccaaagggaaaacaaacataagaagcactaaagagggtatggtaggggagagttcaagagagaagggtgttggtcaaacaaggctgaagcctctacattgggataaggttgcagcaaatgttgatcattcaactgtgtgggatcagatcaatgatggctctttcaggtttgatgatgaactaatggaatcactctttggatattcaagcagctataaaacccaagaaagaaacagaactctttccactttggccaagtccaattccaatgcaccagctcaaatattcattcttgagccaagaaaatctcagaacactgcaattgtgctaagatcacttgctatttctcgcaagggaatcttggatgcagttcttgatggtcagggactaagtgttgagacactagaaagactaactaaaatagctcccacacaagaagaggaagccaaaatcatccaattcagtggcaacccggatcagcttgctgatgctgaatctttcctatacttcattcttaaagcagttccaacagcattcaaccgtttgaaagcaatgcttttccggtcgagttacaattgcgaagttcttcagctcaaggaacagctacaagcacttgaaatgggttgcaaggaactgagaactagtggcctgtttttgaaactccttgaggccattctcaaagctgggaaccggatgaatgccggaacatcaagaggcaatgcacaaggtttcaacttgagttctcttagaaaactttctgatgtgaaaagcacagatgggaagactagtttgcttcacttcatagtggaacaagtggttcaatcagaaggaaaaagacaagctatctatcaaaagcacaaacttcacataagcaatggtgaaacaagcaatgtgaataatagaccttattcatatagcctcatacaacaagaggcagataaagaacatgtattgcttggtttgcaagtattaggtgggctaagtgaagagttatctgaagcaaagaaagcagctagtcttgagtatcataatttcatcactatgtgttcaactctcaatgctcatgttagtgaaatcagacagattataacatgctgtggcaatattaggagtggtggatttatcaatgaaatgaaagggttcctagaggaatgtgagggagaacttgacgtggtgaaagaggagcagacaaggatcatggagcttgtgaagaaaacaaacgagtactatctagcaggagcatctaaagacaacatggtaaacccttttcaactgtttgttattgtgaagagttttgttgacatggtagataaggcttgcatagaactaaaaaagaaggtagaaaagaagaatattgtgggaggagaggctgtgtcaacaacaccacctttgtcaccatcaaagaggacgccgctcagattccctaactttgatttgtattttctatcgaatgtgtcagaaactacatcttctagccaatcagaagatgatttctga

SEQ ID NO: 4466 - DNA, 960 bp, Glycine max var. Williams 82
atggctaattctcttaatagccacttttttgtagtagtatttattctttctctcttggccttttctagcaatgcacaactatctcccaccttctatgccaaaacttgccccaatgttcaaaccatagtgagcagtgcaatgaggcaagctgttgctaaagaagccaggattggtgcctctattcttcgtttgttctttcatgattgctttgtaaatggttgtgatggatcaatcttattggacgacactgccacattcactggcgagaaaaatgcaggaccaaacagaaattcagcgaggggcttcgaagttattgataccattaaaaccaacgttgaagcttcttgcaatgccaccgtgtcgtgtgctgatattctagcacttgccacaagagacggaattgtgctgctaggaggaccctcatggacagttcctctaggaagaagagatgcaagaacagcaagccagagtgcagccaacaaccaaatcccaggaccctcctctgacctctcaaccctaatctctatgtttgcatccaaaggcctaacagcaagtgacctaaccgttctttcaggtgcccacacaataggccaagcacagtgccagttctttagaactcgcatatacaacgaaaccaacatcgacaccaacttcgccgccaccagaaaaacaacttgccccgccaccggagggaacaccaacctggcccctctggaaaccctaaccccgacacgattcgacaacaattactacgccgacctcgtcaaccgccgtggccttctccactccgaccaggtgcttttcaatggtgggtctcaggattcccttgtgcggagctacagtggcaacagtgctgcattttctaaggactttgctgctgccatggtgaagttgggcaatattagtcccctcactgggtccagtggggagatcagaaggaattgcagggttgtgaattaa

SEQ ID NO: 4467 - DNA, 2100 bp, Glycine max var. Williams 82; identical to SEQ ID NO: 1398

SEQ ID NO: 4468 - DNA, 420 bp, Glycine max var. Williams 82
atgggttctcttatggcaggatgggactctctgaccttggatcctgaatcagctacaattgagaggaatcgatctctcaccaaagaggaaattaatgctttctggaaaacaaagaaggaggccgagttagaacacctcaaagctctttccaaattatctgagactattcgggcccgcaaatgcgagtattcagaaaattctcacaggtcaagtaccgcgaccgtggccttaggcatggatggtgacaaaaaaagtttggagaatcttatcaagaaaaattgctggtggaccaagagcagctgggcatttctgaatgaaccgccagttatagaagctgcttccaacaagtatgcttcacagtttcaagtggccaacttgggatcaacgaaatttaaccccggagatggaattagtgcttga

SEQ ID NO: 4469 - DNA, 189 bp, Glycine max var. Williams 82
atgttgtacatgaaaggtgaacaacatgagactgtggttttgtttcaaattttgcggcactggaggaattttgtttctaaatataaaaggtgtaatcaaaacttattgtataagcagctaagtagacaaagaacaaaaaaccggatgcacctgcgagatggagaagggcaaaccaaaatgcagcattag

SEQ ID NO: 4470 - DNA, 1719 bp, Glycine max var. Williams 82
atgggaatctgcagaaatatgggtacccaaccaagggtacaaagaaggctaggaggaaacagagctgcactttttgtatatgctatggaaggactagagaacatggcttttgttgctaatgctgtgagcctagtaacttacttctttgggtacatgaacttcagcttaacaaaatctgccacaaccctgaccaactttttgggaactgcatttttactagcactggttggtggattaatcagtgacacctatctttctaggttcaagacttgtgttctgtttgcatgcatggaattgctgggatatggtatcctcacagttcaagcacgcttccaccaattaagacccatcccctgcaaagatctggcaccaacccaaatgagtcaatgtgaggctgctacaggtggccatgctgcaatactttatactggcctataccttgttgctttaggaaccggtggtattaaggcagctttaccagccttaggggctgatcaatttgatgaaaaagatcccaaggaggcagctcaactgtcaagcttcttcaactggttcttgttcagccttaccataggagcaataattggtgttactttcattgtttggattggtgtcaacctaggatgggattggagttttattgtatgcacattaacaattctattcgcaattgtcttcatatgcatgggcaactcattgtaccgaaacaatgttccaaagggaagccctctaattcgaatcatccaggtgtttgtggcagcctttagaaacagaaaacttccgattccagataatacagacaaactacatgagattcatgaaaagcgaggaggggacaattttgaaatccttaaaagaacagatcaattcagattctttgaccgggcagcaattgctagaagcagcacaggtgcagcaacaaactcaggaccctggagactttgcacagtgacacaagtggaagaaacaaaaatcctaatccgcatgctaccaataatagtcagcaccatatttatgaacacgtgtttagctcaacttcagactttcactatacaacaaagcaccaccatgaacaccaacctaggggggtttaaagtgccaggaccctctgtcccagtcatccctttgatgttcatgtttgtcctaatccctttatacgaccgtgttttcgtcccgctggctcgaagaatcacggggattcccaccggaattcgacaccttcagaggattggaattggtttggttctgtctgctgtttccatggcagtggctggttttgtggaaacacaccgcaagtccgtggccataaagcacaacatggtggatagcagagagcctttgccaataagtgtgttctggctgggtttccaatatgctatttttggagctgcagacatgtttaccctgatagggcttttggagtttttctatgcagaaagttcagctggaatgaagtcacttggcactgcaatctcgtggtgttccgtcgcattcggttacttcacgagcacggtggtcgttgaggtggttaacaaagtgagtggagggtggctggctaataacaacttgaatagagacaacctcaactacttctactggttgttgtctgtgttaagtgttgtaaactttggattttacttggtttgtgcttcttggtatagatataaaacggtggaaaacgagcaagatgattcaaaagataatgttgacatggcctag

SEQ ID NO: 4471 - DNA, 252 bp, Glycine max var. Williams 82
atgtgcatggagaccactaaaaatgtcccccacaattcccattgtgtctttaaattattattatatggtgagcatagttcgctacgtacacatgatcgatcaagcgacatcagcaattggatcggagctccttattattattatctttggctgaatcctcttgtcagcatgtctccaacaattttcagacttccaattgtaccaataccaataggaaaggttcacatcagatattttgaggttggcaagtga

SEQ ID NO: 4472 - DNA, 1092 bp, Glycine max var. Williams 82
atggggactaacaggcaggagcatgaaatttcaggaggatccgaggtaacatatcaggagatggtagaaaatgaagtcaaggacactcagaaaggtccaacacgcaaattaataactgagagctgcaaatcaaacagcatggttataaagaaacgacatacgttgattcctcctcacatcatagctgaagccatatcaactatccctgatcttgacattagatggtcaggtccaatcacaccaaaagaaatggaatatgttgaacaatatgttctagcaaagtatccagaatattcaggcctcatggaaggagaaggaaatgggataaacttgtctagctttatgatctttgaggagcctaattcagaaccaatgatggatgataggggcaagtcaccaagagagtcttctacatatttgtttggaagcaataatctccctgaaatggatagggccaaaatccagttagagccatcaagattactagacattctcaacaagaaatcctcattccctggaagtttcatctctatcccagaaatccaagcacgcaacaaggttttgaagcattatggtttgcctgatgaagagtaccttgttctcttcactccaagctacaaggatgctatgatgttggtgggagaaagttacccttttgtcaaggggaactattacatgaccattcttgaccaggaagaagactatataagggaatttgcttcttttaaggagtccaaggtgatctcagcaccaaagacttggctggatttgaggatcagcgggtctcagcttagccaaaacttcaggaggaggtgtaagatcagctcaaaaggcttgttctcttatccggtcgatgcaaatggaacaatgcattggatttctgaggctcataggaacaattggcatgttctacttgatgcttctgccttggaagtgggaaaggaccggctgcatcttctggcacttcaccggccggactttgtgatctgtagtcttgacaaccctcattccaatccttcaagagtcacctgcctcttagtgagaaagaaatcctttgaggtctcagctacttcatctcaggcagttgaatga

SEQ ID NO: 4473 - DNA, 414 bp, Glycine max var. Williams 82
atgccttgttgtttgtgcttttttttcactatgaatgaaagaagttccatgaatcccttacatgacatgttggagtctcacatgcagttttattttataggaagaagagcttactatagttacattatctgcttagcactgaagaatagaaacctcagaaaatggattctgcggaagtggactggcgtggtattgcttctgttcatctttgcatatgaatttaatcacatcctcttaaataagacgagccgaatcaataccactctagtacacttcactgcatatatggctgttcttcctaagtcaaactatgctgatttcagaaataatgaaaggaaaagtggaactccattatattgctcttattcatgcacgaaacaaattaaccacagatcacatgtattttccacatga

SEQ ID NO: 4474 - DNA, 1902 bp, Glycine max var. Williams 82
atggttgccgacgaagcttcaccattcgagaccagcgagatgctggcaacgttcctgacgtcgacgccgctgctatcggagtcatggcagctgtgcacaaccgccgccgccgccgcgcctcggagtttcgtgaccgagcaacgcggtggcggcgtggtgtacgtggctttccccggggtcgaaatggtggcggcgtcgacggactctagctggagaaactttgtggcgttggatagcatcggcgacatgccactgttctcggcgcgtcgtctcaacaaggaaggcgatgagcctgtgatggtgcatgctgggatgctgaatctcttttccatctttttcgaaccattccaaaaacagatgttggcaatcatgggagacaccaacaccaaattcattgtcataactggccattccattggaggagccacagcctctctatgtgctctttggctactatcttaccttcaccagatatcttcctttatgtccgtgtcagtcttatgcatcacttttggttcaccaatgctagggaatggttctttctcacgtgctattctcagagaaagatggggtggtaacttctgtcacgtggtctcaaagcatgacataatgccaaggcttctctttgctcccataacctcttacactactcagctaaacttcctgcttcagttttggcaactgtccatgactgatccaggctttgggaagcttgcaatttcaatttctgaccaacagaaagagttgttcgactttgtgatgagtcacttggatgcagccacacactatggtgaagggtctgcacatgtttggtttcacccgtttgggagctacctttttgtttcatcagaaggagcagtgtgtgtggatggtgcaaatgctgttataaagatgatgcatttgatgtttgcatcaggttctcttgcttgtagtattgaggaccatctgaagtatggagagtatgttaagaatttgtctttgcaattcttgaaccagaacaattccatgcaggggagcattcacgattcaagctatgaagcaggacttgaattggcggttcagtcttcaggtttggctagccaggaatcagaaatcgaacctgccaaggagtgccttaagatgacaaggaggatgggtccatcaccaaccaagaatgctgctaacttagcaattacattatcaaagtttgtgccttatagggccgaaatagaatggtacaaagcttggtgtgaccagcaagttgatcaaatgggatactacgacttgttcaagaggagaaggagcacttcgagaatgaccatgaaagtcaacatgaatcgtcacaaacttgccagattttggaacaatgtgattgaaaaactggagacaaatgagctgcctcatgatttagcggtgcgggctaaatgggtcaatgcttcacatttctacaaactattggttgagccactagatattgcagagtattatgggaaggggatgcacacaaccaaggggcattacatacagcatggcagagagaggaggtatgagatttttgataggtggtggaaggatggaatggccaacacggaagaaaataatgagaggaggagcaagtttgcaagtttgacccaagattcatgcttttgggcaagggtggaggaagcaagggagtggttggacagtgtcagaagtgagagtgacacaacaaagctggctgtgctgtgggataacattgagaaatttgagaagtatgctatggaacttgttgataataaggaggtgtctgaagatgttcttgccaagaactcaagttacagtatatggctggaagatttaagaggactgcgggaactcaaagcaaaggtgaagaggttttcacaccactttaacccgtttctggatggagaagtaattccttaa

SEQ ID NO: 4475 - DNA, 1983 bp, Glycine max var. Williams 82
atgaagcgcatgaatgagagtaacaacaccgatgatggaaacaatcataactggttggggttctctctctcgccccacatgaaaatggaggttacttcggcagccactgtttccgacaacaatgttccgacaaccttctacatgtccccttctcacatgtccaactccggaatgtgttacagtgtcggggaaaatggtaacttccattctcctcttaccgttatgcctctcaagtctgatgggtcacttggtatcttggaagctctcaatagatcacaaacgcaagtgatggtgccaacttcgtctccgaaattggaggacttcttaggtggtgcaactatgggaactcacgaatatgggaaccacgagagaggtttgagcctagacagcatctattataactcacaaaacgcagaggctcaacccaacagaaaccttctttcacatcccttcaggcaacaagggcatgtgaatgtcgaaacacacccttattactctgtatttgcttgtcgaggtttgtatcaggcaccgtcggaggaagaagcaacaaaggaaacgcacgtttcagtaatgcctcaaatgacaggaggaggtttgcaaaactgggtagctccaacaagggagtattcaactcatcagcagattctggagcagcaaatgaactgtggcatttggaatgagagaagtggggtatctgttggaactgtggggtgtggagagttgcaatctctaagcttatctatgagtcctggttctcagtctagttgtgtcactgctccttctggaacagattctgtggctgtggatgcaaagaagagagggcatgctaaacttggtcagaagcagcctgtgcatagaaaatctattgacacatttgggcaaagaacgtcgcagtatagaggcgtcacaaggcatagatggactggtaggtatgaagcgcatttgtgggataatagttgcaagaaggaagggcagactaggaaaggaagacaagtatatttgggaggttatgatatggaagaaaaagctgcaagagcctatgatctcgcggctcttaagtactggggaccttcaacgcacataaacttttcgatagaaaattaccaagttcaacttgaggaaatgaagaacatgagcagacaggaatacgttgcacacttgagaagaaaaagcagcggattttctagaggtgcttcaatatacagaggggtcacaaggcaccaccaacatggaagatggcaagcgaggataggcagagttgctgggaacaaagacctttaccttgggacattcagcactcaagaggaagcagcagaagcatacgatatagccgcaataaaattccgcggcgcgaatgcagtcacaaactttgacatttcaagatacgatgtcgagagaatcatggccagtagtaatctcctcgctggggagcttgcaaggcgaaataaagataacgatccaagaaacgaggccattgactacaacaagagtgtagtaacaagtgtgaacaatggggaaacggttcaagttcaagcaagaaacaacaatgaaaatgattcggagtggaagatggttttatttaatcaccctttacagcaacaggcaaatggcagtgaccataaaataatgaactgcggaaattccaggaacagtgcattttctatggccctacaagatctcattggggttgattcggtgggttctgagcagcataatatgctggatgattctagcaaaattgggactcatttttcaaacccgtcctcgctggtgacaagtttaagcagctcaagagaggctagtcctgagaaaatgggtccctcgcttctgttcccaaagcctcctccaatggaaacaaagattgtgaaccccattggtacgagtgttacctcttggttaccctcaccaacggttcaaatgaggccatctcctgctatctctttgtctcacttgccagtttttgctgcttggactgatacttaa

SEQ ID NO: 4476 - DNA, 915 bp, Glycine max var. Williams 82
atgcctcctgatgtaattcaatttcgtcctaccttagcacctcttcaattttcttcacaacttacattaaagcaacgttctagcccaagagatcatcgccaaggaatgaacctcaccaacaaaaagaaactcatgcctatccttcttttgatcctttcaatcatatcaatactcaggcttctgagcctcattctccgcacttcatcatctgctactatgtctccaccacccagttcttcacttttttccactcacaacaaagttgcaaaacatgcacccgattcctcaaagcaccccaattccaccctaactgaaaaagagttcaaagttctctcaaacctcgttgctcttaaatccccaagcaacctcctcatatttgggttccaaccgcagtaccttaccctctcttcaatgaatgcacctggaagcaccatctttctttatgatgacatgatagccaaggtagcaacaaactccaataacactcaaacatacaaacttgggtataatgtgccatctaaaaaggcttataatttgctcaaacatgcaaggcagaaccaattagcttgtgcaccaagttacccaaaactactgcttcagaaatcgaaatgtaagcttgcattgatgaatttacctgcagaagtgtatgaaaagaagtgggatatcattgtggtagatggacccaaaggggattcgccagagtcaccgggtaggatgggttctatatacactgctagtgttctagctagagctgggaatgtttctgacgtagttgtgcatgatgtggatcgtatgatagagaaatggttttccttggagtttctctgccatgagaatttgttgtgttctaaagggaaattgtggcacttcaggatcagtggtcactccaattcaacaacgttctgcacttcctga

SEQ ID NO: 4477 - DNA, 1923 bp, Glycine max var. Williams 82
atgtcgagcatcgtcaaggagatcctggcgagcccgatacaaatggcggaccaggtttcgaagcttgcggaagaggcccagaatttccgacaggaatgtctggaactgaaatccaaaactgagaagctggcgggcctcctccgccaggccgccaggaacagcaacgacctctacgagcgtcccacgcgccgcatcatcgacgacaccgaacaagtcctcgacaaggccctcgttctcgtcaccaaatgtcgcgccaacagcctcatcaagaagctcttcaccatcatccccgccacagccttccgcaagacctccatgcagctcgagaattccgtcggtgacgtccaatggctcctccgcgtctctgcctccgccgacgagcgcgacgacgagtacctcggcctccctcccatcgccgccaacgagcccatcctctgcctcatctgggaacaggtcgccattcttctctccggcgcttccttggacgaacgttccgacgctgccgcttccctcgtctccctcgctcgcgacaacgaccgttacgggaaactcatcatcgaagaaggaggcgtgccaccgctgttgaagcttctcaaggaaggaagaatggacggtcaggaaaacgctgccagagccatcgggttgcttgggaaagatcctgaaagcgtggaacacattgtcaatgctggtgtctgttccgtgtttgccaaggtcctcaaagaaggccacatgaaggttcaaacggttgttgcgtgggctatttctgaactcgccgcgaatcacccgaaatgccaggatcatttttctcagaacaatgccatacgcttgctggttagccatctggcgtttgagacaattcaagagcatagcaagtacgccattgcgaacaaacacaaatccattcactcggttttaatggcgagtaacacaacgagcgcgcaggaagaggaagatgataagcagatggtggctcacccgggggcgaatcagtcagccaatctgatgcacaacgtggtttccaacacaatggccataaagggagccatggtggaggaggagaaagccaacaacaagaagcaacaacaacaacagcagcagcagcagcagagtgggaataattcgcaaatgtcaattgcagggacgagtattaaggggagggaatatgaagacgcggggacaaaggcacagatgaaggccatggcagccagagccttatggcaactctcgaggggaaacttgacagtgtgtaggagcataacagagtcaagggctctcttgtgtttcgcggttctgttggaaaaaggaccagacgatgtgcaatcgtattcggcaatggcgttgatggaaatcactgcagtgtcggagcaacattcggagctgaggcgctctgctttcaagccaacttccccggcagccaaggcagtggtggatcaactcctaaaagtaatcgaaaaagaacaaccggacctgctcatagcttgcgtgagatcagtgggaaatttggcgaggacattcagagcaaccgaaacaagactcatagggccgttggtgaggcttctggacgaaagagaggcgcaggttagcatggaagcggccattgcgctcaataaatttgcttgtacggacaactaccttcatgagaatcactgcaacgccatcatagaggcagggggcgccaagcacttgattcaactcgtttactttggggagcaaatggttcagattccttccgtcacgctgctttgttacatagcgctgcacgtccccaaaagcgagactctggcgcaagaagaggtgctcattgttctcgaatggtgcaccaagcaggcacatctcatcgaggaaccctccatccaaccactcttaccagaggccaagagcaggctcgaactctatcaatcaagaggaagaggattccgctga

SEQ ID NO: 4478 - DNA, 1389 bp, Glycine max var. Williams 82
atggcaccaccgaaccccccacccacttcagaagcaagttcctccgccgtacagaaagtgaaaagcaatctcgtcttccgttcaacctgggccgaactcaacggcgccatgggtgacctaggtacatacatacccattgttctgtccctaaccctagccagtgacctcaacctcggcaccacattgatcttcaccggcatgtacaacatcatcaccggcgccatctacggcgtccccatgcccgtccagcccatgaagtccatcgcagctgtcgccctcgccgaccccaccttctccataccggagatcatggcctccggtatcctcaccggagcaaccatgttggtcctaggcgtcaccgggctcatgcagctagcttacaagctcattcccttgtgtgttgtgaggggaatccagctagcacagggtttgtcctttgcgttgaccgcggtcaaatatgtaagaaaagtacaagatttgcctcggtccaaatcaatggaccaaagacactcgcttgggttcgatgggttgattctcgccatcgcatgtgtttgttttattgtcattgtaaatggtgctggcgaggacccgaatcacgatcatgatcatgaccacgacgaagaaccatcccaccaaatccaagccagaataagtaataaagtgagaaaaataagaagggttatttttgcgcttccttcggctttcttggtgtttgtgttgggagtgttgttggctttcataagaaggcctagggtggtgcatgagattaaatttggaccctcttctatagaggtggtgaaaatgtctagacatgcatggaagcaaggtttcataaagggcacaatccctcaactcccattgtcaattttaaactctgtgatagcggtttgcaaactatcatcagacttgtttccaggtaaagatttttcagtgacatcactctcagtaactgtaggtttgatgaaccttgtgggagggtggtttggggccatgccatgttgccatggagctggtgggcttgcggggcagtataaatttggagggaggagtggagggtgtgttgcacttcttggtgcggctaagttgattttagggtttgtgttgggaagttctttggctcattttttcaaccagtttcctgtggggatcttaggggtgttgctcttgtttgctggggttgaactagccatggcttctagggacatgaatactaaagaagattcttttgttatgcttctttgtactgctgtttcgttggtggggtccagtgctgctcttggattcttgtgtgggatgattgtttttgtgcttcttaagctaagggattggataaatggtaagccgattaatgctatttggaagcatgaaggccctgatgagcaagtttga

SEQ ID NO: 4479 - DNA, 1815 bp, Glycine max var. Williams 82; identical to SEQ ID NO: 1333

SEQ ID NO: 4480 - DNA, 249 bp, Glycine max var. Williams 82; identical to SEQ ID NO: 1337

SEQ ID NO: 4481 - DNA, 1770 bp, Glycine max var. Williams 82
atggtgggcccacagtacgattttctggcgaaccctttgggcgtcgtcagatccaccttcgatgccgccgtagcctctgtttccgatccctccgccttcgacgggcgcgactggggcgtcttcccgctcttccaccacttcctctccgaccagtccagtctctctcaggttccacttctgacccctgccaccatcaaatgggtgaagcctaatactctggttcggtttcgcgggatgatacaagacatgctcgggaacgaattttacattggcgcttataaggatggttcggtgtggaggacgaacaagtttatggatgtttctcaatctcttatggcttcttcggtggatatgcgaatctgggaacgtcgactgctttattgtgttccggttccaggactgagtccatggactcaagtttcagttgaagaatttggcgatctatctatggattgcaaatcggagaatagagaaaagcggaggagagaagatggcgagtcttctgatatgcctgtatctggtgatgaggttcagaattccccaaatagtaaaagaatgagagaaggtgaacactcttctgttgcttctcattctcagggagctgcaactgagattgccagctctggtaccagtttggtgtctggtcttgatagcaattcacctccctgtcttgtgaagatatatgattctccagattctgaattgaaactgaatgacatttttgagtttgtgggtatccttacatctgatctagagcttgaagaggacgatgaagattgtgatttatcagatggattttctgaagatcctttgcgtcatctcccacctagcaaggtgccacaccttcattgttttattcagaggaaattagcggttcacgacttccttcagcacaatcctattgtagagccaaggcccaacttggtcagaggaatcagggaagcattgctaaggcatctcacggctgttcttagcaatgatgatttggctactcatttcatgttgctgcatcttctatccaaggtgcatgctagagcagatgatcttgctgtgggaaagctttcattaaatcttacttgttttagcaaagaaaccgtgtctgtatttggaaaaccactaagcgttgctttgaagaacctcctgccattcacattttgcataccccttacagttgaatacttgaattctgtttcacttacgccaaaaaagaattacgatactaatagactggaaactggagtcttacaactagctgaaggttcacacttgattgttgatgagaccaaactagaagctggaactctcaactctgtaggggtagagaatacaaggctactgaaaaatttaatggaattgcaaaaggttgaatatgatttcaagtactataaagtggatatgacaactgatttccaactgctagttttgtcggaggggaaatcaaatatcttgccagccgatgtaattgtaccgttccgaccttctgcaaccagttgctctggagctgtgactgcagaagctttggaggcctggaggtggtatttggccactgtcagacagctatcacacactattgaaccagaaatgcagaaggtgatagaaagtgatctagttgcagcaagacaagcagacaggagcttgagctcccaagatttaagcagattggtaacaatgggccgtctcatgtcattgagctatggtgagaccagcttgtcactagaacattggcaaatggtcaaggaactagaaaggctgcgaagagagaggctataa

SEQ ID NO: 4482 - DNA, 1575 bp, Glycine max var. Williams 82
atggcagctccaaagccagaggagataagccacccaccaatggaccaacttcaaggcttagagtactgtatcgactcaaacccttcctgggtggagacaatagttcttggtttccagcattacattttggccttaggaactgcagtcatgattccttcatttcttgtgcctttgatgggtggaagtgatgatgataaagtgagggtggtgcagacgctgctttttgttgaaggaattaatacacttctgcagacactctttggaacccggttaccaacagtgataggagggtcttatgcatttatggtccccattatatcgataattcatgattcctcattgacaaggatagaggacccacatttgagatttcttaacaccatgagagcagtacaaggggcaatgatagtagcatcaagcatacaaatcattttgggctttagtcagttatgggccatttgttctaggtttttcagtccacttggaatggtcccagtaattgcattagttggatttggattatttgaccgaggattccctgtggttgggcattgcgttgaaattggaattcccatgttaattctgtttgtagtcttctctcagtacttgaaaaattttcatacaagacaactaccaatactagagagatttgctctactaatatcaaccacagtgatatgggcatatgcacatctcttaacagcaagtggagcatacaaacaccgtcctgatttaacccaacataattgcagaacagacagggccaacctcatttcttctgctccatggataaagattccataccctcttgagtggggtgctcctacatttgatgctggtcatgcttttggaatgatggctgctgttttagtctccttaattgagtcaactggggcatacaaagctgcatcacgacttgcaagtgcaacaccacctccagctcatgttctgagccgtggtattggttggcaaggagttggaatcttgctgaatggcctttttggaacactgactggttcaacagtttctgtagagaatgtggggctcctaggaagcactcgtgttgggagtcgaagggtaattcaaatttcagctggttttatgatattcttctcaatgttaggaaaatttggagctttatttgcatcaataccattccccatttttgcagctgtatactgtgttctgtttggccttgtggcttctgtggggctatcattcttgcagttcactaacatgaactcaatgaggaacctctttattcttggtgtagcccttttcttaggtttttctgttcctgagtatttcagagagtacacttcaaaggcccttcatggtcctactcatacaagggctggatggttcgatgatttccttaatactatattcttctcatctccaactgttgcattgattgttgctgtattcttggacaatactcttgattacaaggatagcgccaaagataggggaatgccatggtgggccaagtttagaacattcaatggagatagccgaaatgaagagttctatacacttcctttcaacctcaaccggtttttccctccacgataa

SEQ ID NO: 4483 - DNA, 987 bp, Glycine max var. Williams 82; identical to SEQ ID NO: 1230

SEQ ID NO: 4484 - DNA, 1095 bp, Glycine max var. Williams 82; identical to SEQ ID NO: 1295

SEQ ID NO: 4485 - DNA, 216 bp, Glycine max var. Williams 82
atgggtttcagtttgcgtggtgttcaaagacgtgtggatgtcccaaagggctgtgtagcagtgtatgtgggagaaaatcaaaagaagcgctttgtgattcccatatcatacttgaaccaaccttcatttattgagttgttgaatcaaagcaagaatttggatttgatcatccaatgggtggcctcacgattccttgcagagaagatgtgttcctag

SEQ ID NO: 4486 - DNA, 2973 bp, Glycine max var. Williams 82
atgttcgtgttttttctgctattcctctgctttctctctcctcttccgcactctctctctctaacccaagacggtctctttctcctcgaagcaagacggcacctttccgacccggaaaatgccctctcctcctggaaccctgccgccaccaccccatgccgttggcgcagcgtcacctgcgaccccctcaccggcgccgtcacctccgtgagcctccccaacttttctctctccggccccttccccgccgtcctctgtcgaatcgcctccctgaccaccctcaacctcgcctccaacctcatcaactccaccctctccgccgtcgccttcgctgcgtgccgcaacctcgtcttcctcgacctctcccagaacaaccttgtgggccccatcccggactccctcgccggaatcgccactctccagcacctcgacctctccggtaataacttctccggcgcgattccggcgagcctcgcctcactcccttgcctcaagacgctcaacctcgtcaacaacctcctcaccggaacaataccctcttcactcggtaacctcacttcattaaaacaccttcaactcgcttacaacccgttctcgccgagtcgcataccgagtcaactcggtaacctcaggaacctcgaaacgctttttctcgctggctgcaacctcgtgggccgcatccctgacactctcagtaacctctctcacttaacgaacatagatttttcgcagaacggaatcaccggtcacattccgcagtggctcacgcgcttcaagcgcgtgaaccaaatagaactcttcaaaaacaaactctccggggagttacccaaaggaatgtcgaacatgacgagtttaagattcttcgacgcgtccacgaacgagttgactgggacgattccgaccgagttatgcgagttgccactcgcgtcgttgaatttatacgagaacaagctcgaaggggttttgccgccgactattgcgcgttctccgaacctctacgaactcaaattgttcagtaacaaacttattgggacattgccgagtgatttggggagtaactcgccgctgaaccacattgatgtttcgtttaaccggttttccggcgagattccggcgaacatctgccggcggggggagtttgaggagttaattttgatgtacaattatttttccgggaagattccggcgagtcttggcgactgcaagagtttaaagagggttcggttgaagaacaataacctctctgggagtgttcctgatggggtgtggggtttgccacatttaaatttgcttgagcttttggaaaactctctttctgggcaaatttccaaggcgatttcgggcgcttacaacctgtcaaatttgttgctttcgtataacatgttctctgggtcgattcctgaggaaattgggatgttggataatcttgtggagtttgctgctagtaataataatctctcgggaaagattccggagagtgtggtgaagttgagtcaattggttaatgttgatcttagttataatcaactctctggagaacttaattttggtggaattggtgaattgagtaaagtcactgaccttaatttgtcacataatatgtttaatggaagtgttccaagtgaattagcaaaatttcctgtgcttaataatcttgatctttcttggaacaatttttctggggagattcctatgatgttgcagaatttgaagctcactgggctgaatttgtcttacaatcagctttctggggacattcctcctctttatgccaatgacaagtataagatgagttttatagggaatcctgggatatgtaatcatctacttgggctttgtgattgtcacggtaagagtaagaatcggaggtatgtgtggattttgtggtccacgtttgcacttgctgtagttgtgttcattattggggtggcatggttttactttaggtacagaaaggcgaagaaattgaagaaggggttaagcgtttcgcggtggaagtcgtttcacaagctcgggtttagcgagttcgaggttgctaagttgctgagcgaggacaatgtgataggaagtggagcttctgggaaggtgtacaaggtggtgctcagcaatggtgaggttgttgtggcagtgaagaaactgtgtggagcacctatgaatgtagatggaaatgttggtgctaggaaagatgaatttgatgctgaagttgagactctggggaggattaggcacaagaatattgtgaagttgtggtgttgttgcaacagtggggaacaaaggctcttggtttatgagtacatgccaaatgggagtttggctgatttgttaaagggtaacaagaagagcttgttggattgggtcacaaggtataaaattgctgttgatgctgctgaggggctttgttatttgcatcatgattgcgtccctcccattgttcacagggatgtgaaatccaacaacatattggttgatgcagagtttgtggctaaagttgcagattttggagttgccaaaatggttacaggaatcagccaagggacacggtcaatgtctgtgattgcaggatcctatggctacattgcaccagagtacgcgtacactctccgtgtgaatgagaaatgtgacatatatagctttggtgtggtccttttggagttggtaactggaagacccccaattgatccagagtatggtgaaagtgatttggtcaaatgggtttcctccatgttggaacatgaaggactagatcatgtgattgatcctacattggactccaaatacagggaagaaatcagcaaggtattgagtgtggggcttcattgtaccagctccatcccaataactcgccccacaatgagaaaggtggttaaaatgcttcaggaggtaacaactgaagttcccaaatctagaagtgtaaacggtggaaatgttccatgttcctatgaaggggcatctcatgctatcaatgaagtgtag

SEQ ID NO: 4487 - DNA, 1437 bp, Glycine max var. Williams 82
aaacccagaatccgtcaagtaagttcccggttcatgtctccacactcgaccggttcgcccgaacctggttcagcttctccgcttccccggttccaccgggcagcgaagagaaactcctccactctcgcggatcatatcggcaatgagaggctcaaagaaagggaagaaaatcatcagaatcagaaccagacacccacaaacagaacaggctctgttttctctgttctcacgaaacagaggagcctcagagagttcagaaataacatcaatgggtcggaagaaaacgatcaagatcaatacattaatggcaagtccacgaggaatggtttctctgcaaaatttcctgcttcgccggtggtgaagaaaccgagttctcatattgctccgggaagactctctctggatgaaaatgccctcaagaaaaactttcattgttctaagaactcaattgattctgaatcagataatacgagtttggattctgtttctctgcaaagaacatttagttcgaggaaattgggtagggaggtttcatctaagtacatgatgacaacaagtggtagaaaaggagaagcttctgattcagaccctttatcctctgatgattcatggatgatgaaaaagcttattacacagaaagctatgaagagggctaattcgcttattgggtacatgagttccaagtctcagtgggcattgtctcctgggagatcagggtcacctcctttgtctttggaaagtaaggacaagccgttgtcgttttcaagcttgagacctcaacacaagagagtggagaagattcttagcatgggttttgatctctttaggactaagaaaccttcaacatgtgaggtggttcatcagttgcgtctgcttcataaccggttgattcaatggcggtttgcaaatgctagagcaaatgatgcgaatcacaccatgtctcttcaggctgagagcaacttgatatatgttttggatggtctagccaagctccggcattcagtgatgcaaaagaggatagagcttgagagagaaaagattgagatgaagctaaattttgtactgcattctcaaatgaagctgttggaaacatggggaagtatggaaaggcagcatctaactggaattaccataatgaaagagtgtttgcagtctgttgtatgcaaagttcctctcttggaaggtgcaaaagtggatatgcaattagtgtccattgctcagcggcgtgcatctgatctagctgattctataaagtcagtgctatctaccttttcacccttggctggtaagactgctgagttgctatcagagttagcgagagttgtcgcgcaagagaagttgctcttacaggaattgaatgatatcttccacaacatgtctgtccttgagcttaaagaaaggagcctgatgtgcagtctcattcaactgaagtgttga

SEQ ID NO: 4488 - DNA, 1185 bp, Glycine max var. Williams 82
atggtgtattcggctgacgagtcggatgttctcacgttagatcactcaaacttctccgacactgtaagcacgtacagtctcatcgtcgtcgagttctatgcaccaaggtgtggccactgtaagaagcttgctccggagtataagaaagttgcttctatcttgagtagtcatgatcctcccattgtattggctaaagttgatgcgatgacgagaagaacaaagaccttgcatcagaatttgaagttagggattctgagaaatgggggaaagaatgttcaagaatacaaaggtccccatgaagcagacggcatcgttgactatttgaagaaacaaagttgtagtgtttccaaattttctggggaggagtttgacaactttactgcagagaagttgcgtgctgactatgacttgggtcacactatgaatgccaaacaccttccaagaggagaatcatcagtcactgggcccatagttaggttatttaatccatttgacgaattttttgttgatttccagctacagtcccaattcaaaggtgctgaatctttcaaatcaaaataccgagaaactgctgagcaatatagacaacagggtttaagctttctggttagagatgttaagtctactaaaggttctttccagtattttggagtgaaggaagaccaagtacctctaattacggtaacacgtaatgatgggaagaaatttcttaaacccaatttggaacctgatcacatgtcaacttggttgaaggcatacaaggaaggaaatattgccccatattttaagtctgaacctattcctgaagccaacaatgaacctgttaaagtggtagttggggacagtctccaggacatagttttcaactctgggaagaatgttttgctggaattttcttctccctggtgtggttattgcatagaattagcaccaatattggaggaagttgctgtctcatatcaaagtgatgctgatgttactattgcaaaactggatggagttgcaaacgatatcccaagagaaacctttgaagtcagaggttatccaactgtgtacttcaggtcagcaagtggaaagatatcacaatacgatggcaataggactaaggaagacattatagaattcattgaaaagaaccaagacaaacctgctcaacaaggaaaagatgaactagaaaaaggataa

SEQ ID NO: 4489 - DNA, 696 bp, Glycine max var. Williams 82
atggttaagtcagaacacaagatcaaaaccgaaccatcatcaaaggcaatgcggttatcttcaccctcatcatcaacatcagattgcaagaagaagaagtacaagggagtgagaatgaggagctggggatcatgggtttctgagattagagcaccaaatcagaaaacaagaatatggttaggctcttattcaaccccagaagctgcagctagagcctatgatgctgcacttctatgccttaaaggctcctcagcaaatctcaatttccctttaagctcttcacaacaatacattcctggagatgctgtcatgtcccccaaatcaatccaaagagttgctgcggccgccgcaaatagtttcatcgacaatgccaccactcccccttccccacctccggcttcgaccccatcatcatcatcattggcctcatccccctcattggtttcttctccctcggatcaaatcgatgacgacgccttgctgatatcgtctttccaagcctacactagttgtggtcaagcaaatcaatcaatggctgtgaatgtgatggagccttggtacacctttggtgatggtcttcaatcccccaagtatgctgatcagatgctaagtggtgatttcttccatgtcgattcttcccatctgcttgatgatctatacgaagaaagtgacattcgtttgtggagcttctgctga

SEQ ID NO: 4490 - DNA, 228 bp, Glycine max var. Williams 82
atggccgccataaattttgctaaggaattggctctgatcttgatgatcacaatgattgtcatgttagttttggagccacagcctgtggagtgtgcatttgctgtcccactcaatccctgcacacttcctgagtgcattgctcaatgcaagaaaattctgcacgcaaaatttatgagtgcatcttgcacaactggctctcagggaaacctttgcatttgcttaggttga

SEQ ID NO: 4491 - DNA, 1035 bp, Glycine max var. Williams 82
atggcggattcagtgtcggtggacatggaagccatctctcctccacctgaggaacatataataagaactcgtcatggtcgtgtctccgttgctgtgtatggggaccaggacaagccagcgctaatcacgtatcctgatttggctttaaattatgtctcctgctttcaggggttattattttgtccagaagcctgttcactgctgctccacaatttctgtatatatcatattagtccacctgggcatgagttgggagctgctgccattgatccagatgatccaattctttctgctgatgacttggctgatcaaatagctgaagttcttaactattttggtcatagtacagtcatgtgtatgggagtaactgctggggcttacattcttaccttatttgctatgaagtatagacatcgtgttcttggtttggtactagtttctcctttatgtaaagcaccatcttggactgaatggttgtacaacaaggtcatgtcaaatttactctacttttatggcatgtgtggggtggtaaaagaaatattgctaaagcggtactttagcaaggaagttcgaggcagtgattatttgtcagagtcagatgtagttcaagcatgccaaaggtcattggatgagaggcagagtttgaatgtgtggcggttccttgaagcaattaatgggagatatgacataagtgaaggattgagaaaattacagtgtcgttcactaatttttgttggggatatgtctcctttccacgctgaggctcttcatatgacgtccaagttggatagacgactcagtgccctagtcgaggttcaagcgtgtggatcaatggtaacagaggagcaacctcatgccatgttaataccgatggagtattttctcatgggatatggcttgtacagaccatctaagctgagtgtcagcccaagaagtcccctgagtccctcttgcatttctcctgagctttactctccagagagtatgggtttgaaattgaaaccaataaagacacggatttccgtggagatatag

SEQ ID NO: 4492 - DNA, 777 bp, Glycine max var. Williams 82
ggaggagtacaaaatggcggaaaggcagagtataactatacggttgattcggcgagagcgtctttggttagacaagaggacaccatcatttttggtttgattgagagagccaggttccccttaaattctccaacctacaatcaaagttacgcttccattcctcaatttcgtggcacattgctcgattttctcgttcgtgacacggaggtcattcaagctaaggctggaagatacactaaccttgaagaaaatcctttcttcccagaaaatttaccaccttcggttgagccacattaccccttctcacagtttttgcatccttcagccgctatgatcaacataaacaatgtcatttggaaactgtacattgatgagctgcttccaatatttgttgcttctggtgatgatggaaactatgcacaaactgctgctaccgatctttcattgttgcaggcaatctctagaaggattcattacggaaagtttattgccgaggccaaattcagagaatctcctaaaggctatgagcctttaattcgtgctaaggacaaagaagcattgatgaaattattgacaattgagagcgttgaagagatggtggtgaagagggttaaaaagaaggccatggtgttagggcaggaagtgagccttgatcgtaatgtcaagggaataaaatacaaggttgatccatcagtagtttctttcttgtaccagaaatggttaatacccctcacaaaaaacgttgaagtcgaatacttattaagccgcttagactga

SEQ ID NO: 4493 - DNA, 1872 bp, Glycine max var. Williams 82; identical to SEQ ID NO: 1324

SEQ ID NO: 4494 - DNA, 276 bp, Glycine max var. Williams 82
atgtctggccagagaaacttcagaacttcaaaattcacggaaagtgagattaatgatctgatgttgaggctacaagcactgctaccacaactaaaccaaacaagaaactcaagggcatcagaaagcttgatgaagatcatgaaggaaacttgctctcacatcaataggctacagaatgaggtgaaagaccttggtgaaaggctagcagagctgattgattctgtagaccttagtgacattgacgaggagtgtcttacaagacttttacaacaataa

SEQ ID NO: 4495 - DNA, 1785 bp, Glycine max var. Williams 82
atgtcattgtcatctctagttagaagacgctcaagcgacgaaataaccaactcggcctcggtttccagtagcctctttccagcatttggcaccaccatctttgatgttgaaggttactcgaagtcgaacctaagaaaatatgtcattgctccctatgaccgtagatatcaattgtggcaaacgttccttgcggcattggtagtgtactctgcatgggcatctccattcgagctagctttccgggaactgttagttgggtcgctgttgcccaagattgctctcaggtacgtcaaaaagttacacttcaccatggatatagcctccactgtgccatttgagcagatacatcaaattctgacgggcaaaccaaccaaaagcgaggtctttggtttcctaattatgcttagactatggcgattgaggcgtgttagcgaactcttcgcaagatataatacgtatttaagtgtgccacctaattttgaaaaaaaagacatacgaattaactacccagcaacaagattttgcaaacttatatgcgtgacgctatttgcagtgcacttcgcaggctgcatgtatttttggttggctgtccaactcaaaacacccaaaaacacgtggatcgggaacaaaacagaggattttaatgatttgagcgtcgggttgggttacacttattccatgtactggtctgttgcaacccttactactgttggctatggagatttctatgcagtgaatttaacagagaagcttttcagtactttatacatgctgtttaacatcggcctcacttcatatataatcggaaacatgacaaatctgttagttcatagctctgtcggaacatttgcaatgaggaatgccttcaacagaatattacaatatgcaaacaaatatagactcctggaaggcttaaaagagcaaatgtcggcacacatgcaattgaagtttaagactgcagagttacagcaagaagtgctacaatacctacctaaaacaataagatccaatattgctcggcatcttttccaaaacatagttgaaacagcatatttatttaaaggagtgtcagaaacgaaagcagaatactacccatctaaggttgacattatcttgcaaaatgagatgtcaacatatttctacattttggtatccggatcactggatgtgttgatgtacaagaatgggtccgaacagtttttgttcaaacttgaatctggaggcatggcaggagaaataggcgtgatgtttaatattccacaaccttttacagtgagaagtagagggctctcccaggtcaaacgaatcaatcatcgtcatttcaagcatatggtgcaaccatttagtgatgatgtgaaggcaatcaactacaactttattaagtattttaagggcctcaaaggcaaggtgctagaagaaatatcatatataacagaattgatgggtgaccttcatgatgagcatttaatgcaaaatgtgggtacagacgatgaagtttcaagatatcaagaagcttcatataaagaaggaagaaaaggaaattccaaaccactgtcaagtccagtccccattagagttaaaatccacggacaccatcccaatgaacacaaagtgggaaacgaaacaacaccaaagatcatacttctcccaaattcggtagaagatcttttcagtgttgcagagaaaaaatttggaaacagaggaagcaaaattcttatggctgacggctcagaggtagaagaattaagcgcaataagggagaatgataagttatatatcctctaa

SEQ ID NO: 4496 - DNA, 2469 bp, Glycine max var. Williams 82; identical to SEQ ID NO: 1315

SEQ ID NO: 4497 - DNA, 1068 bp, Glycine max var. Williams 82; identical to SEQ ID NO: 1375

SEQ ID NO: 4498 - DNA, 1377 bp, Glycine max var. Williams 82
atgaaaagacattcacaacacagcagcaatgatccattttgtgaagctcacaacagaacaagacaacaacaccaatgcatgatgatgatacaacaaccaaacaatgatgttgttgttgtcccagaacacacatgtgcacaacaacaccaaaaccaatctccaaaattggcttcttcttctttcacttcccaaaatgctacacctgtgctacctgcttttgttgccttgctgctccttgttacttcaattgccccaacagcattgtgccaccccttgcagggcactaaccacacttttaggccaaatcatgagttgctcaagttgaggagagtcagagctcacttgaagaaaatcaacaagcctcccgtcaagacaattcagagtccagatggtgatttgatagattgtgttttatctcaccagcaacctgcttttgacaatcctaagcttagaggccacaaaatattggatcccccagagaggccaaagggaaaccacaccaatggtgaagctgaaagggtaattgagagctttcagctgtggagtgattctggtgaagcatgcccagaaggaactgttccaatcagaagaactacagaggaggatattctcagagcaagctctatccaaagatttggaagaaaaccaagacctgtacggagagactctactggcagtggtcatgagcatgcagttgtttttgtaaatggggatcaatactatggagcaaaagctagcataaacgtgtgggcaccccgtgtaactgatgaatttgaattcagcttgtcacaaatgtgggtaagtccacagctatatggagacaactatccaaggttcttcacttattggactactgatgcatatcaaacaactgggtgctacaacttactctgttcaggctttattcaaaccaacaataggatagcaataggtgctgcaatttccccaagatccgctttcaacagaagacaatttgatattggcctaatgatttggaaggatccaaagcatgggcactggtggctggaattcgggtcaggactactagtagggtattggccagcaaacatgttcagtcacttgaggaaccatgcaagcatggtgcaatttggaggagaaattgtgaacactcgttcaaggggttaccacactggcacccaaatggggagtggcaattttgctgaagaagggtttagaaaagcagcatattttagaaacttacaagtggttgattgggacaatagcttgcttcctcttagaaatattcaccagttggctgatcattccaattgctataacataaggcagggaaccaacagtgtttggggcacttacttttactatggagggcctggaaggaatgtgagatgcccatga

SEQ ID NO: 4499 - DNA, 1227 bp, Glycine max var. Williams 82
atgacaagcactcttctgtctttgcttttcttgctcttctcccttctcattccatccttcatttcctcttcaccagttcgaaaccctgaagaagtcgtacaagaggtcaacaggaaaataaatgggtctatagcaaggcctaggagaaacttgggctacctctggtgtggcagtggcaaccccattgatgactgttggaggtgcgaccccaactgggagcagaacaggcagaggctagctgactgcgcaatcgggttcggcaagaacgccatcggcggcagggacggcaagatctacgtggtggacgacgacggcgatgacgatgccgtaaacccgaagccgggaagcctccggcacgccgtgatccaagacgagcccttatggataatcttcgcaagagacatggtgatccagctgaaggaggagcttctcatgaactccttcaagaccatcgacggaagaggcgccagcgtgcacgttgctgggggtccatgcataacgatacagtacgtgaccaacgtcatcatccatgggattcacattcacgattgcaaacagggagggaacgctatggtgcgggactccccacggcactacgggtggagaaccgtgtcggacggcgatggcgtgtcgatcttcggagggagtcatgtgtggatcgaccattgctcgctctctaactgtaacgatgggttgatcgacgccatccatggctccaccgctattaccatttctaataactacatgacgcatcatgataaggtcatgttgttgggtcacagcgatgcttacacccaggacaaggccatgcaagtcactattgctttcaaccactttggtgaaggccttgttcaaaggatgccaaggtgtaggcttgggtatttccatgtggtgaacaatgattatactcactgggaaatgtatgccattggtggaagtgctaatccaaccatcaactgccaaggcaataggtttgttgcacccgatgacagattcagcaaagaggtgacaaaacgtgaagatgcgccagagagtgagtggcaggattggaattggaggtcagaaggggacttgttagtaaacggtgcgtttttcacatcatcgggtgctggagcctcctctagctatgcaagggcttctagcttaagtgcaagaccatcttcccttgttggttccataacaacaggtgctggtgcactcagttgtaagaaaggttctccttgctga

SEQ ID NO: 4500 - DNA, 363 bp, Glycine max var. Williams 82
atgaaagggcaagcatatggagtccgtagcattggtgatggaaatgatgccccggctatctatagtgctattcaagctgctcgtcaaatggcaattactgaagagagaccaattctaatagaagctcttacatatagagtgggacaccacaccacatcagatgactctaccaagtatcgtcctgcgaacgagattgaatggtggagactgacacgtgatcctgtggctagatttagaaagtggatagaaaagaatggctggtggaatgatatggctgagtcacagcttataaacaatttgagacagcaggcgagatatacatctctaaatcccttgattgatgataactggattccattctaa

SEQ ID NO: 4501 - DNA, 864 bp, Glycine max var. Williams 82
atggccattgaagcacagttgtttcccaacaatgctcctccgattccgttttatgggtcaaagaatttaatggcagacaattcccaagcagcatatggtcataggcaacaaccagtagaacaacatcatgcctggcagatgaatcagaacatgtctcttgttgatcccaacttttcttgtttttctaattccaatgtccaccactacgccctccataagaacgttattcaacctttagcctcatatcctcaaagcttggctattgtgtttgatcaacagagggagattgatcactgtatcagatcacagaatgaaaaattgagtattttgttgcaagagcaaaggaaacagcatgtgtcagagttattgaagaaggtggaagcgaatgctcttcatttgttgagacagaaagatgaagaaattgcccaagcaacaaagaaaaccactgagttgaaagaatttctgacaaggttggaggtggagaaccaatcatggcggaaggtagccgaggaaaacgaggctatggtactgtctcttcataacaccttagaagagatgaaagaaagagctctgtatagggtgacagcagaggatgcagagtcgtgttgggatgaaaacatgagaaacagggcaatggaagaaggaacgggagaaaacagattgtgccgtggtggtggggtggaagaggttgaacaaattaggaaaaggacaatggattgcaaatgttgtaattctcaaaaatcgtgttttatgattcttccttgcaggcacctctgttcgtgtaaaacttgtgagccttttctgcaagtttgtcctgtctgtagtatgcctaaaaagtccagtatagagactttaattgtatag

SEQ ID NO: 4502 - DNA, 591 bp, Glycine max var. Williams 82
atggattactattttggaaaccttaatcctaacccttattaccatcactctgccgtagtgaacatggcatctccctcctccgagttcatgttatctgattatctcgtgttggaagatgctcttgttgttgatcatcatcaagagtcttggtcacaaagcactgaaactgaatcgtcggagaaagcaacctccagcgatgcaagtcatgggttcggtgatgcaacctccaacaccaacatgcatataaagtgccaaaatagtgggattaagggaaagaatgcagaagtgagtcaaaggataacgtttagaaccagatcgcaacttgaggttatggatgatggatataaatggaggaaatacgggaagaaaacagtgaagagcagtcccaacccacggaactactacaagtgttcaggtgaaggatgcgatgtgaagaaaagggtggaaagggatagggatgactccaactatgtgttaacaacgtacgacggtgtccacaatcatcagaccccgtctactgcctactacagccaaatgcccttgctgcattctaatcatgattgggccctccacccttctgcaaactcataa

SEQ ID NO: 4503 - DNA, 2088 bp, Glycine max var. Williams 82
atgaacaagcaaatggataatgttcgtttccaaccgaaatacgtaaggaaagttgataatgagaaacagtactttaatcactttaatcgaaggatgtgggttgagaaagaaagaaaagagaaccgcaacttgacttcaatacccgacttgtttgtggtttcccttttgctgcaagttgtggctttcaaaagtacagccagaaaaattctggctaagccatgcatgccccacaaattgaatccatatcgtatagtcgtccaccaatgcttacccccccaaacccgtgttttatgtgatacacggtggcttcggctgcgctctgaggaagtggcagcgtcactaggcacattcatgcaaactgcacctagaatggtcagcataggcaactatgaggtgaacttgttagctagagaagacatagaacatcaactgtggcgtgttaatggtttcggaggaaatggatattcatcaaccgtctttaatgtcatcagtgatgcaactgaagcttctgagtcacaagttagaaaacagttattgtcacctttgaatgggatgctgcttgcggatcattttaaaggtgatccactagacattggtgctggtatttatcaaagtcgttcaaaggctggtgatcataattctaatgctttacatgagtataagaaggatcatattggaaacaacaataagattcattcaatgatctggactacatcttgttttcaggaatttacaaattcatcctgtaatgacaatactataaaccatattgtatctagtcatcaccaacgtgcagagccatggtctattaagcattttaaatcatctccagtacgtaatgcttctgaagaaacaactaaaacaaggtcccaaacagctgcattgtctataccacaaaaaaatgtgtcatcacctaccttccctttgtctcctctgggtaaaaaatcttctaaaaatgaaaatttgggagaatgcagaaatattgatgttatcttggacaatgacaattttacttttaatagtgtggaacagtcacttgatagaacttgtcaaggcatttcatcagcacaggagataccaagtacatcacagctcaatttgaacaatatgcagcaaaagtctgacctgtttactcctgacaacatgattaatatgaaagagtattggactcattctggtagctttcctccttgggatgccaagttacgtggaactatgagtagactgccaattagaaggtccttggttggttcatttgaagaatctttgttatctggtcgcttactatctgggaaagttagtcagaaaattgaaggctttcttgcattcctgaatgtaactggcggcaatttctcacctcaatcacagaaaataccatttgcagtaaccagcgtggatggagacaagtatttactttattattcatcaattaatctttcaggaaagctattatcaggcaagtctagagttgctaaatttcagagaacccttagcatggatgaatctcgatctgaaaagccccatatacgtgtacctatgaaaggacgtattcaactggttctcaccaatccagagaggacacctatccataccttcttttgcaattatgatttgagtgacatgccagctggtaccaagacgatcttgcggcaaaaggtcactttaactgcgtctagatcaatgtctatgacgggtaacgaaagccaagcagattctgacatcaaagctgatgccaagtcgtcgttgatctcagtcacacgccaccgagataaagatcttctcaccacaaaatgtggagagtttgatagtctgacatgttcaaaggctggcattttgctttatgctcttcaccttcgcttcatgtgcccctttcctaagagacgttcaaggtctgttcataagtgcaaatctggccctgtctctgctgaagtgagaaatattgtggacgttgaacatgaaagaagcttctacttgtatgatgatatgagggtagtgtttcctcaacgtcattcagattctgatgagggaaagttacatgtggaatatcattacccttcaaatccaaaatatttcgacatcagctgctga

SEQ ID NO: 4504 - DNA, 435 bp, Glycine max var. Williams 82
atgggttctcttatggcaggatgggactctctgatcttagatcctgaatcagctacaattgagaggaatcgatcactcaccaaagaagaaattgatgcttactggcgagcaaagaaggagacagagttagaacacctcagagctatttccaaactatctgagactattcagacccgaaaatgcgaggattcagagaattctcataagtcaagtactgtgactttggccagcataaaggagtccttaggcatggacgttgaccagaaaagtttagagcagcttatcaagaaaaatggctggtggaccaagagcaactgggcatttctgaatgaaccgccggtgatagaagctgcttccaacgagtatgcgtcacagtttcacgtggccaacttggggtcaacgaaatttaaccccggagatggaattagtgcttga

SEQ ID NO: 4505 - DNA, 753 bp, Glycine max var. Williams 82; identical to SEQ ID NO: 1306

SEQ ID NO: 4506 - DNA, 525 bp, Glycine max var. Williams 82
atgcccaccccaaaaagcctcgttctttcgctcctcctccttctgggcctctgttccggcgacggcggcggtggcgctccgccgcaggagctgtggtgcgtggcgaagaacaacgcggaggacgcggcgctgcaggccgcgctggactgggcctgcggggccggcggcgccgactgccgcccaatccagcgcggtgggccctgctacgaccccaccagcgtccagaatacggcgtcgtttgccttcaacgactattttctgaaacatggcatgaccgacgatagctgcgacttcaacaacaacgctgccgtcacttccttgaaccctagtcatgataattgcaagtttccctccggtaagagtgggagcaatgggagtttttctggatcaacgcccacttcatctgttggattgggacccagtaaagatttcagtgggtgctcgagagtttcttggggatggtggtggttttggcctttgagtttgatcgggcatttgatgtttatggtttctgtttttggatga

SEQ ID NO: 4507 - DNA, 504 bp, Glycine max var. Williams 82; identical to SEQ ID NO: 1275

SEQ ID NO: 4508 - DNA, 1044 bp, Glycine max var. Williams 82
atggctacttctgatcaaacacttgtttgtgtgaaacaagtgaagcaagaggtggcggatgagtgggatgagagcatgccattaccaggggatatcattgaaggattttctgagcgcgacgctgatgatgattcctttttaccggtcaaggccagttcagagtttagttctcagcttggaaagattaacccgcgtggggaactcatatggatacaggttagaagaggtgatagcttgatgaaacttcaagtacgcattgtgcagcagaagggttccatacttcaaagagtgaacaagcgggggagagaattccgcagaagtgggatcaaatatgactggaagatgaaaataggcacctatctgtctgaccaatgttgttcagtaataagctccattctatttatgcctctaattagtgagtaccgcatcgatactaccacaactaggtgcatggcatggtttagtgcagcaatttcctctggggtccctcttgtttttgtcaatatccaaacagaacaaattccctccacggaggagactcatttcttgaaaagggaaatagctactagcaagcaaaaaatcaacaatgctaaccaaataatgcatggtataaggttatggtttctacctggactagcagaaatttcagttgtgttaatccctcaacctgtcgaagcgcgctttggcatggaaattaaacgaactaaagagagctttgtgtacatatattcagtgatgaggggatcgccggctgatcgtgctggggtgagagaaatgtatgaagagtcaagtgcaaatgggttccttttggtgatatcaaggttgcaatgcaagagcataatgccaacgagtgcttgttctgctggccttgtgcattgctgtgaccaatctgaaatgaaggacattctcacttcagctatagaccaatatgagacgattcagctgcatgtcatggcctggccgaaccaaactcgtccttctccaattcctgatgttggtggttttgcggccctgctacatccaaaaagagattcatcattatga

SEQ ID NO: 4509 - DNA, 786 bp, Glycine max var. Williams 82; identical to SEQ ID NO: 1331

SEQ ID NO: 4510 - DNA, 1560 bp, Glycine max var. Williams 82
atggcttttctatcatcagttcttaagcaattggcgtatgaaccaagttcaacccattaccttacagctttcttctgcttcgtaagcctcctgcttatgcttaagctaacaagaagaaacaagtccaattttcctccatcaccaccaaagttaccaataattggcaatcttcatcagctaggcacactgccacaccgctccttccaagcactctctcgcaagtatggccctctaatgatgctgcaattaggccaaactccaaccctagtggtctcatcagctgacgtggccagagaaataatcaagacgcatgatgttgttttctccaaccgaccacaacctacggctgctaaaatctttctctataattgcaaggatgttggttttgcgccctacggcgaagagtggagacagacgaagaagacatgtgtggttgagcttctgagccagagaaaggtgcggtcgtttcgttctatccgagaagaggttgtttcggagttggttgaagctgtacgtgaagcatgtggtggtagtgaaagagaaaatcgaccatgtgtgaatctgagtgagatgctgattgcagcttccaacaacattgtttcaagatgtgtaattggacggaagtgtgatgctacagtgggtgatagcgtgaattgcagctttggagaactgggaagaaagattatgagactattctcggctttctgcgtcggtgatttcttcccttcgttgggttgggttgactatctgactggccttattccggaaatgaaggccacgtttcttgcagttgatgctttccttgacgaggtaattgcagaacgcgagagcagtaacaggaagaatgatcactctttcatgggaattctccttcaacttcaagagtgtgggaggcttgactttcagctcagccgagataacctcaaagcaatcctaatggacatgataataggtgggagcgacaccacttcaacaactctagaatgggcttttgcagagctccttaggaagccaaatactatgaagaaagctcaagaagagataagaagagtggtgggaatcaattctagagtagtattagatgaaaattgtgtgaatcaaatgaactacttgaaatgtgtagtcaaagaaactttgagattacattcacctgttcctcttttggttgctcgagagacatcatcaagtgtaaaactaagagggtacgatattcccgccaaaacaatggtatttatcaatgcatgggcaatccagagggatcctgaattatgggatgatcctgaagaatttattcctgaaagatttgaaactagccaaattgatcttaatggacaagattttcaattaattccatttggtagtgggagaaggggatgtcctgctatgtcatttgggcttgcttcaactgagtatgttcttgctaatcttttgtattggttcaattggaatatgtccgagtctggtatgttgatgcacaacattgacatgaatgagaccaatggactcactgtctccaaaaaaataccacttcatcttgaaccagaaccacatataccctga

SEQ ID NO: 4511 - DNA, 498 bp, Glycine max var. Williams 82
atgagaaccatccccacaacaacctcaactacaatagcacccacagccaccacgtcatcattaacaacaagtccttctcagcactcctccacatggcactctccggttccgtacctgtttggaggactggctgcgatgctcggtctcatagcctttgcgcttttgatcttagcctgctcctactggaaactttctggtcagttacagaacgaggaaaacgccgaaagggacttggaaagtgttgttggtggtgagaaacagggtgactctgcaaacaaggaatcagttacggtgtacgaggagaagattctcgtcattatggccggagatgagaaacccacattcttggccaccccgaaagcctcctcctttgtccctcatggtgtccccaaccattttgaggaaaacctcgaaaaccatgtgacttctgagaaatcagagaaaaaccatgttcaacaacctacgtctccgcaacaacagagccagccacgacaataa

SEQ ID NO: 4512 - DNA, 765 bp, Glycine max var. Williams 82
atgggtgttcttcagtatacacttctctacttgatcttactacaatcatgcaagattattgcttacaaagaccaggagtggaagaaagctactgcaactcatgcaaatgacacagagggatctcttattacagaaggagcatgtggttatggagacctccacagggccagttatgggaaacacagtgctggtttaagcactattttgttcaacagagggagcacatgtggggcttgctatgaaatcaggtgtgttgatcacatcttgtggtgtgtgatgggaagcccttctgttgttgttactgttacagatttctgtgctccaaattatgggctttctgttgattatggtggctggtgcaactttccaagagaacattttgagatgtcacgggcagcatttgctgaaattgccaagaacaaagctgatatagtgccggttcagtatagaagagtgaagtgtgaaagaagtggtggcatgagattcacaatgagtgggagttctcacttctatcaagtcctgatttccaatgttggtctggatggtgaagtgtttgctgtgaaagtgaaaggatctagatcaggatggataccaatggccaggaactggggacaaaactggcattgcaatttcaacttccaaaatcagcctttgtcctttgaggtaaccagcagcagtggaaagacactcacatcttacaatgtagcacctgcaaactggatgtttggacagacatttgaaggaaaacaatttgagcatgagtag

SEQ ID NO: 4513 - DNA, 1092 bp, Glycine max var. Williams 82
atggctcttcttctagacaactgtgaaggcattttactctctttggactcacacaaatcagtgccagctcctttcctcaccaaaacataccaactggtggatgatcccgccacagatcacattgtgtcttggggcgaagacgacaccaccttcgtcgtttggcgtcctcctgagttcgcaagagaccttcttcctaactacttcaaacacaacaacttctcaagcttcgttcgccagctcaacacctatggttttagaaagattgtgccagaccgatgggagttcgccaacgaattcttcaagaagggagagaaacacttgctgtgcgagatccatagaagaaaaaccgctcagcctcaacaaggaagcatgaaccaccatcaccaccattctcattctcccttaggagtcaacgttagcgtcccaactttctttcccttctccagcagagtcagcatctctccctccaacgactccgacgaccaagccaattggtgcgactcgccgccacgtggatccacctcattggtgaacggtgcagcagcagcagccaactacaacacttccgtcacggcgctttcggaggacaacgagagactcagaagaagcaacaacatgctcatgtcagaactcgcacacatgaagaagctctacaatgacatcatctacttcgttcagaaccatgtcaagccagtggctccaagcaactcttactcttcttctttgctactatgcaatacaccttctgccactccaataactagtggcggcaatgtttcaatgacgcaaaggccaacgaaccagcttctgggctattattctactaaccctaagcaaggagctacacaaataactcaacctcagacctatgttgtgaactctcccaccaacacatcaaggagttctataaccattgttgaagggcctaacagcaacattaacagctgcaagaccaaactttttggggtgtcgctgcagtccaagaaaagggtgcacccggattatggatctaatccagagaccaacaaggctcgtttggttttggaaaaggatgacttgggcttgaatctcatgcctccatccacttgttag

SEQ ID NO: 4514 - DNA, 1872 bp, Glycine max var. Williams 82
atgagtctcaaacccatatgggtattcttcattgccatctttttgtttcttctagtggccaattcagaagaagaagaagtgatcaaggccctagtcacgttcatggataaattggcaccaggaaatgtaccaagagaccctatgtggggttggaaccttaactcagatccttgcattgataagtggcatggtgtgaagtgctactcagacaacaaatatgttaagagtgtaattcttgagaaattcaactttggtggagttgtagatgctagttctgtttgcattgctaagtctcttcgaatccttaggctgacggacaacattttacatgattcgatatccgaggatataggaaattgccagtccttgactcaattgttcttaagtgggaaccaactctctggggaccttcctatttcaattggcaagctaagtaacatgaaacggctgcatgtttccgacaatcacttcactggagagcttcctaacatggttcatgtttcgggtttgatatccttttttgctcaaaacaacaacttcactggggagattcctagttttgacttctccaaccttgatgcctttaatgtctctaacaacaatttacaaggtcaagttcctgatgtcaaaggaaaattccatgaagacagcttttctgggaatcctaacttatgtggaaaaccgctttcacaagaatgtccaccacctgaaaagaaggaccaaaactcattccctaatgatttgtccatttattcaggttacttagtccttggtttaattgtcctgcttttcttgaccttcaagcttttaagtaagctcaagatcaaagaaaaagcattggatgttgaaaagaaggaaatggcagaagaaactgttagtgttgctggcaaggctagtgaaatatccaattccatcgtgtcaaagaatggcactgtgattagatcagagtgttccttgacatctttggaaagtgggatgacaacatcaggccttgttcttctttcaagtcgaacgcttcgaggattgcaatttgaggacttgcttggtgcccctgctgaattgattaggaggggaaagcatggaagcctctacaaggttatgctcgataatggggtgttgttggcagtgaagaggatcaaggattgggggatttcaaagcaagattttgagagaaggatgaatttgatagcccaagcgaagcatccacgcgtattgccacctgttgcatactattgctctcagcaagagaagctcctagcatatgaatatctgcagaatggtagtctcttcatgtttctctatggatctcaaagtggccactcttttgactggagaagcagattaaatgttgctgctaatatagccgaggctttggcatatatgcatgaggagtttcttgagaatggaattggacatggtaacttaaagtcaagtaacattttgtttgacaagaatatggatccatgcataagcgaatatggcctaatgatggcagaaaatcaagatcaacttgtcccttcccataacaaaggcctcaaaagcaaagatctgattgcagctaccttcaaagctgatgtacatgcctttggtatgatacttctcgagcttctgacagggaaagtaattaaaaatgatggatttgatctagtcaaatgggtgaattcagtggttagagaggaatggactgttgaagtttttgacaagtccctaatctcacaaggttcttctgaagagaagatgatgtgtttgttgcaagtagcattaaaatgcgtaaatccttctccaaatgataggccaagtatgagccaagttgcagtgatgacaaattctttgatagaggaggaagaaaaatccatatcctttgacacatga

SEQ ID NO: 4515 - DNA, 288 bp, Glycine max var. Williams 82; identical to SEQ ID NO: 1263

SEQ ID NO: 4516 - DNA, 1476 bp, Glycine max var. Williams 82
atgtcagggattagcaagcagcaagaggtaatatgtgctcagggtttacgtttatggcgtaatagttcttctgaggtgaacaatgagctatataaaggttattggagaagtaacatagagagacagatcaatgagatagctgcaggttatgattttttaaattcaaatgggagtatatttaacgtcagcatatggtacaactcaacctacaaaaaggacactggctttaatccaattgcattggcgcgtattcctcgttctgtaaatttggtatcaaatgcgtaccttcagtttctgttgggacctggtaccaaaatgttttttgagtttgtaaaggaaatgccaaaacctgagaccccaattaaattggatttggcttctcttttgggtggtgtcttctttacatgggtcatcttgcaacttttccctattcccttgacatcgctagtatatgagaagcaacaaaagttaagaatcatgatgaaaatgcatggtcttgatgacgggccatattggatgatttcgtatggttattttcttgccatatccattgtctacatgctgtgttttgtgatatttggctcagtcatagggttgaatttcttcacaatgaatgactacagcatccaatccgtgttttatttcatctatataaatttacaaatttcactggcttttttattggcttccctgttttcaaatgttaaaactgctacagtacttgcatatataggtatgtttggaactgggctattagctgactttcctttccatttttttgttcaagacacatcatttccaagagggtggatcattgttatggagttgtatcctggttttgctttatatcgtgggctatatgagttttcgcaatatgcctttagtggggatgctttggggaccgatggtatgcgctggagtgatctgagtgatagcacaaatggcatgaaggaggtcttaattatcatgtttgtggagtggctattggtgcttttgtttgcttattatatcgatcaagttttgtcttcaggatgcaggaaaagtcctcttttcttgaaaagatttcagaaaaagccccattcatcttttcggaagcctagtatccaaaggcagaaatctaaggtttttgttcagatagagaaacctgatgtcactcaagagagggagaaggtggaggaactgctacttgaatcgactattaatcaagcaattgtatgcgacaacatgagaaaggtctatccggggagggatggcaacccggagaaacttgcagtgagagggttgtcccttgctttgcctcaaggggaatgctttggtatgcttggtcccaatggtgctgggaagacttcttttatcaatatgatgattggtctcaccaagccaacctctggtaccgcatatgttcaaggtcttgacttaagaactcatatggatggaatatatactagcatgggtgtatgcccacagcatgagtaa

SEQ ID NO: 4517 - DNA, 1014 bp, Glycine max var. Williams 82
atggcagagaacaacaaccaccaccatttcggaaccgccatcagaaggctcgcctctgtgaccaaccacctcacttcttctcacaacgcacccggcgaactcgccctgtgccgcacttccggtaggagcgacagcttccaccgcgtccagggccacgtcccctcccacgacgtcgtttggaggatcatcgcctccgaccacgacaactccggcaaggacttcaccgacattgtctacgagaaggccgtcggggaaggaatagccaagataagtattaataggccagagaggaggaatgcgttccgcccccacacggtgaaggagcttatgcgtgctttcactgatgccagggaagatagctctattggggtcgtcattctcactggcaagggaaccgaggcattttgtagtggtggtgaccaggctttgaggactgacaatggctattctgataatggaagtttcagtagcctcaatgtgttagacttgcaggtgcagatacgccgcctccctaaaccagtgattgcaatggtagcaggttatgctgttggaggagggcatgtattacatatggtctgtgatctaactattgcagcagataatgctatctttggccaaactggtcccaaggtaggaagctttgatgctggttttggaagttctatcatgtctcgtttggtaggtccaaaaaaagcacgtgaaatgtggtttctcacaaggttctatgatgccgttgaagcagagaaaatgggtcttgtcaacactgttgtaccacttgagaatttggagaaagaaacgataaaatggtgtcgggagatactgaggaacagtccaactgctattcgggtgctcaagtcagctcttaatgcagtggatgatggccattcgggacttcaggaaattggtggaaatgcaacactgatatactatggcactgaagaagctaaagaggggaagactgcatatttgcaacgtagacgccctgatttttctaagttcaatcggcgaccttaa

SEQ ID NO: 4518 - DNA, 1029 bp, Glycine max var. Williams 82; identical to SEQ ID NO: 3262

SEQ ID NO: 4519 - DNA, 561 bp, Glycine max var. Williams 82
atgtgtgagagacctgtccgtcgtatccctcatgaattcatccctcgcattataaaacctcgccgtgtcacggcctctgagctgtggcctaacttactgcgtgatcctatcattcataacttcatccctactcatataactacacccacaagtgcctctctttttgcctccaagcctcactcattcgattcactcaccagagagtgtccatgtacccttcaaaacgacatgtcgtcgtctattcgcttcgttaagcagactcggaccgcatccgattctcaccgtagaaactggaaccaagtccacccagagttcaatatgggttacagggttcaagttcagcaagaatgcagattacccggaagaacaaacaataagagagagatccaatggcacaacaactcagaaaatagattagcaggcaaaaggaagatgtatgatcttgatgataatttagaatgttcttcgtggcccttattgacagaaactttggacgaggaagacagtgatgagacctcagattcaagttcagattctgaaacatactctggcccctcatga

SEQ ID NO: 4520 - DNA, 1110 bp, Glycine max var. Williams 82
atgatagggtgggaagatgtatacaaagtagtggtagcagtggtgccactctattttgctctattattagggtatggttcactgaagtggtggaacatcttcaccaaggagcaatgtgaagcaataaacaagctagtttgttacttcacattgccactcttcatcttcgagttcactgctcacatcgaccctttcaagatgaacttctcgttcatagcagcagacaccatatcgaagttcatcatcatggtggtacttgccctctgggccaagtgcactcctaaatgcaccttttgctggtccataatcagcttctctttgtgcaatctcaccaacgctgttgttgttggggttccaatggtgaagcccatgtatggagccctaggtgtggaccttgtggttcagtcctcggttcttcaggccaccatatggctccctttgcttctctttgtgatggagttttggagaacgggaattgagggcaccaccaccaccaccgtaaaaccaagatcaaaaacaatgatcaataagaatgaaggtggaggagggaaagatgtggaggctgttgacgtgaaagaagagttgatgttggaagagagtgttactagtaggcttcctttttgcaaggtgatgaagcttgtgtggcgcaaacttgcaacaaaccctaactcctatggctgtgtgattggcatttcctgggctttcatatccaacaggtggaatttggagatgccaagtatgttagaagggtctatacagataatgtcaaaggccgggacgggcactgccatgtttagtatgggtattttcatggcacttcaggagaagttgattgcttgtggaccaagcatgaccttaatcggtttggttttaaagttcattgcgggccctgcggctacggctattggtgccattgctgtaggattgcgtggtgacgttttgcgagtcgtcatcattcaggctgctgtgccacagtccatcacatccttcatttttgctaaagaatacggattgcatccggaggttctcagcactgcggtgatctttggtatgattgtttcacttcccgtcttagttgcctactacgcaatattggagtttgtacattga

SEQ ID NO: 4521 - DNA, 1125 bp, Glycine max var. Williams 82
atggaaaatcacactctccctatggagttgatgagagaaattcttctaagattgcctgtgagatctgtttcgcgttgcaagtgcgtgtgtaagtcatggaattttatcatctccaatcctcaatttggcaattcccattatgatctcgatgccacaccctcccatagactcattctcagatcaaactattcttctcatggagttctatccattgatacaaatgcaccactagacacatgttctgctgcaaagcatttgattctcccccttcattcatccccatgcaatccctacgacaatgaagattatgatggttttccccgtagacccgagattttaggttcgtgcagagggtttatacttttatattacaagatgaatcgagatcttattatatggaatccattgacaagagaccgtaaactatttcttaactctgaatttatgttaacctttcgatttttatatggttttgggtatgacacatcaacagatgactacttgctaatattgatcagattatccttggaaacagctgaaatccaagttttctctttcaaaactaatcgctggaacagagacaagatagaaattaatgttccatattattctaatttagatcggaaattcagtatggggttattcttcaatgatgctctttattgggtagttttctctatgtaccaaagggtttttgtgattattgcctttgatttggtaaaaaggagtttatcagagattcctctatttgataatttaactatgaaaaacacttcagatgatttaactatgaaaatccctgaagtgttaagtttaagagtaataggaggatgtctctgtgtgtgttgtttggtccaatactgggcaatgcccgaaatatgggtgatgaaagaatcatcttggactaagtggtttgtaatcccttatgacttttccccaatatgcatcacaaaagatggaggaattttgggattaaatattagagaaagattagagaaatataataacaaaggagagttgtttgagcatttcaccattgttgctgctgaaggtgaagagtactactgttccttacgagatcaacagtctgctatgtatagagagagtcaactatcgctcccctga

SEQ ID NO: 4522 - DNA, 1617 bp, Glycine max var. Williams 82
atgagtggcttgagtttcaggggcttcacatacatgctcctcattgcatttctcatttggtccttcaattttgaagcctgcattgcaagaagaggcaagcactggagacaaagcagggatgtctcagcttctgtgtacaagaaaaaaggcaaaaattatggcaatgctcacaacaagtaccatggtggaggatcaaaatcaaagcctccatcatcacacaaaggcacaccaacattaccaaagcctccgccacaacataaaaacactccctcaccaccatatccaacaccaccaagtgatgatacccccacaactccaccaccaaaggcttacaatggtggtggccattcttccgccaccaccttcaatgtgctagattttggagccaagggagatggaaaatctgatgacaccaaggcatttcaagaggcttgggctgaagcttgtaaaattgaatcatcaaccatgctcgtcccagcagactacgcattctttgtagggcccatttcattctcgggcccatactgtaaacccagcatcgttttccagcttgatggcaccattgttgcaccaacaagccccaaagcttggggcaaaggacttctacagtggttggaattttccaagttggtaggaattaccatccaaggaaatggcatcattgatggaagaggctcagtgtggtggcaagataatcaatatgatgatcctatagatgatgaagaaaagctcattgtccctttaaaccacacagtagggagcccaagtcccccactgccgattcaaagtgagatgggaggaaaaatgccatccgtcaagccaactgcattgcggttctatgggagttttaatccaacagttacaggcattacaattcaaaatagtccacaatgccacctcaagtttgacaactgtaatggggtcatggtccatgatgtgaccatatcatctcctggggacagtcctaacacagatggaattcaccttcagaactccaaagatgtgttgatatacagcagctctatggcctgcggagatgactgtatttcgatacaaactggatgctcgaacatatatgtacacaatgtcaactgtggaccagggcatggaatcagcattggaagtctaggaaaggataacaccagagcctgtgtctccaacattactgtcagggatgtcaacatgcacaacacaatgaatggtgtcagaatcaaaacatggcagggtggatcaggttctgtacaaggagtgctattctcaaacatacaagtttctgaagttgaactcccaattgtgattgatcaattctactgcgacaaaagaacctgcaaaaaccaaacgtcagctgtgtctcttgccggaatcaactatgaaaggataagggggacatacaccgttaagccagttcactttgcctgcagtgataacctaccttgtgtagatgtttctctaacctctgttgagttaaaaccaattcaagaacaataccatctatacaatcctttctgctggcagacttatggtgaattgaaaactccaactgtcccaccaattgattgcctacaaattgggaagccaactaacaatcggattcagacagatcatgatttatgttga

SEQ ID NO: 4523 - DNA, 1794 bp, Glycine max var. Williams 82; identical to SEQ ID NO: 3269

SEQ ID NO: 4524 - DNA, 2007 bp, Glycine max var. Williams 82; identical to SEQ ID NO: 3164

SEQ ID NO: 4525 - DNA, 2040 bp, Glycine max var. Williams 82; identical to SEQ ID NO: 3228

SEQ ID NO: 4526 - DNA, 759 bp, Glycine max var. Williams 82; identical to SEQ ID NO: 3257

SEQ ID NO: 4527 - DNA, 780 bp, Glycine max var. Williams 82
atggatcaaattaaatcccacaaaatagaagctttgattcaaagcacaaaatcccataactacataattaagcttattcaattattggtcccattatctgtgttttctttcttcatttctccatcttccttgcttgctttcctctaccacttcaacctgtacttctctacattttctttgcaattatttactcacaccatagacaagaattgcatgtttctcctatgcaatggtctccttgtatttgttggcataacaagatctttatctgggtctagtagtgttgctgaaagtgaatcttctaaatatgttgaagatggatcacaatctccatactcagatgttgaggctaatgaggcaataatcttggtggagaaggaagccatggagaaaattcatgagcctcatggacagaaaacaggaacagaacatgcaatagaaatcaagtactctgatgaagaagaagaagaagaaggagaagaaagtataggagacataattttggaaggtgaaaaagaagaaaaagggaatgcagaatcagttttgacagaagagaataagaagctatatggagaaactggacaatttggtgctgaagatgaagacagggagtcagaaattgatgagtttctgattggagaaagtgttgaagaagaggttgtagaagaaccaaactgggtgttaagtactgaggagttgaacaaaaaatttgatgacttcattagaaagatgaaggaagatttgaggatcgaggctcaaagacaattactcatggtttga

SEQ ID NO: 4528 - DNA, 207 bp, Glycine max var. Williams 82
atgcagagtggcagagatagaactgaggacaaggaaatgatgagtgacaaatggctttgtttttctgttcaaacttatgtcttgtacattggggaaatatttcattatcctcatacggaatttcttacgctttatcaacctcacccatttcagcaaatttgtatcttttgtgctgtctcatctagagggttctttttccctgcataa

SEQ ID NO: 4529 - DNA, 279 bp, Glycine max var. Williams 82; identical to SEQ ID NO: 3266

SEQ ID NO: 4530 - DNA, 1962 bp, Glycine max var. Williams 82
atgtcttctaattttctcttccctcaaactcaatccacagtcctcccaaacccttcaacctacttctcctcaaaccttctttcttctccactccccactaactctttctttcaaaactttgttattccaaacgggtcccaagctgagtacattcacccttacctcgtcaaaacctcaaactcttcactctcagcctcataccctcttctcctcttcaccacagcacttttgtaccaatcttttgtgccagatatcacaatctcttccactcaaacacactcaaatcaacaaaaccgtgaaatctcatcatacagtgacctcagtgtcactttggacattccctcctccaacctaaggttctttctctcaagaggaagcccttttataaccgcttctgtgacatctccaacatctctttcgatcacaacagtccacaccatagtctctttgtcttccaatgacgacaacaacaccaagtacacccttaagcttaacaacactcaaatatggctcatatacacctcctccccaatctatttgaatcatgatggcgcttccaatattacatccaagccattttctggcataattcgtgtagcagcgctgcctgattccaactccaagagtgtagcaattctcgacaagttcagctcttgttaccctttgtcgggaaatgcaacactcgtggaacctttccgtgtggtgtatcaatggcaaaaggaaagttctggggacttgctcatgctagctcaccctcttcatgttaagcttttatcaaatagtcaagttactgtgctgaaagattttaagtatagaagcattgatggcgatcttgttggtgttgttggagattcatgggtgttggaaacggatcctattcctgtgacatggtattctaacaaaggtgtggataaagattcgtatgatgaggttgtctcggcacttgttaaggatgtgcaagagctaaattcttcagcaataggaaccagttcatcatatttttatgggaagcgtgttggaagggctgcaaggttggcgttgatagcggaagaagtgtctttttccaacgtggttcccacgattaagaagtttctgaaggagtctattgagccttggttggatggaacttttcaagggaatagttttctatatgaaaataaatggggtggacttgtcaccaaacaaggctctacagattcaactgctgactttgggtttggagtgtacaatgatcaccattatcatttagggtactttctttatggaattgcggttcttgcaaagattgatcctcagtggggacaaaaatacaagccacaagtttattcacttgtcacagatttcatgaacttgggccagagatataacagattttatccacgtctaaggtgttttgatctttacaaattgcactcttgggctgcagggttgaccgagtttgaggatggaaggaatcaagaaagtacaagtgaggctgtgaatgcatactattcagcagcattggtgggtcttgcatatggtgactcaagtcttgttgacactgggtcaacgctagtggcattggaaattctagccgcacaaacttggtggcatgtgaaagtggaagacaacttgtatgaagaggaatttgctaaagataacaagatagtgggggttttgtgggctaacaagagggatagtaagctatggtgggccagtgctgagtgtagggagtgtaggcttggcatccaagtgctacccttattgcctattactgagacattgttctctgatgctgattatgtgaaggagctagtggaatggacagtgccctttttaagtagtcaagggtggaaggggatgacctatgccctgcaaggaatttatgataaagaaacagcattggaaaatataagaaagttgaaaggttttgatgatgggaactctttgagtaatctcttgtggtggattcacagcagatga

SEQ ID NO: 4531 - DNA, 1983 bp, Glycine max var. Williams 82; identical to SEQ ID NO: 3208

SEQ ID NO: 4532 - DNA, 453 bp, Glycine max var. Williams 82
atgggagtgttttccaataagattgatagggaacaattgaaacccggcgatgtcatttattcttggaggcaagcttacatcattgctcaccacgaaactggaacaagaacaatgttggaccgttttcatgtaagttcaccccatcatgcttctcgtgaaactccatgcccgaaatgtgattaccaaacaaagactgaagccaaggctagaggaggaacttgcaccactgcatcttctgatccaaccgaagccgtcctttgccgcgcttcctttcttctcaagaaaggatttggtggctaccatttgttcaagatcaactgtgaggactttgcaatgtactgcaaaacaggcttgcttgtagtcacagacatcagtgtagggcaaagtggacaagcaacatctctcttggctgctgttgatatgattctgatattggagtacgttgtgatgtga

SEQ ID NO: 4533 - DNA, 315 bp, Glycine max var. Williams 82
atgttgaatggcagagaaaaaatatcccttcttgtactttcactattctttagtgcacttatggtttgtttctgcttcatcctagtgatccatttcgtaatggaattgtcatctgtcatgaataatagagctcgaaaaaatcaagaagtgctgtgggcaggatttggcattgctcttttcttaatattttgctttgcttttgttgtctttgctatattttctggttgtcatatggtttatataatgaatagtagcatcaagattgcacctgcacccactcctgaagaagcagaacagcagccacccatggtttaa

SEQ ID NO: 4534 - DNA, 1179 bp, Glycine max var. Williams 82; identical to SEQ ID NO: 3159

SEQ ID NO: 4535 - DNA, 1755 bp, Glycine max var. Williams 82
atgggtaatccttctaagcttttcccatttttctttgcattcattgtgtttctgatgcccttagtttccttatcccacaatgacttctctacctttgccataaaaaccgtttcatacctagtttcctttagtgaaaatccaaaccataatggccacatcaccacaagctccaatgaaagagacaaatcacgtctttggaggaaagccttcattggcttaaaaaatactcacgagccatcttcgaatatttctcgagcaatatcccttaatgcaagagagtgttttcctgtggagttaccttctgatgcaataacttctacccgttgttgtccacctaggccatctccttctaatatcatagatttcaaagattttgcttctccaaacgccacgcttcgagtaagaaaacctgctcacatggtagatgaggagtacatagcaaaacttgaaaagggcattgcactcatgaaagcactccctgatgatgacccacgtaatttcattcaacaagcaaaggtccattgcgcttattgtaacggtgcctatcacctacgccatccctttcaggacacaaaactcaacattcacaggtcttggtttttctttccctttcatcgttggtacctttacttctttgagagaactttgggaaaattaattggtgacccaaactttgccctacccttttggaattgggattctgtagaagggatgcaaattccatcatatttcaataaccccaattcgtcgctttatcaccaactccgaaaccaaaaccacttgcccccacacgtggttgatctgaactacaataaacttgatcctaatgatgatacgccttctcatcaacaagtttcgtataatctagccttcatgtacaagcaaatggtgctagcaagtaccaaagaattgttcatgggaagcccttttcgccttggcgataaccctactccgggtatgggctctatagaggctgctcctcataacactgttcatacatgggtgggtgctgctgataagccacaccatgaagacatgggagcattctacacagcagctagagaccccattttctacgctcatcacccgaactcggatcgattgtgggggctatggaagacattggaaggaggaagaaaggactatagtgatgatccagattggctagattctgagttttacttctatgatgagaatgccaattttgttcgtgttaaggtaagagattgccttgatactaaaaaattagggtatgtttacgaagatgttgatcttccatggctgcgaacgccacccacatcgccgaaaagcaagctactgagagaagcgaacaagagtccacttttgagttcaaagccaagcaaatttcctttggttttggattccataacgagtaccgttgttaagaggccgaagaaattgagaagcaaggaagagaaagaacaagaggaggaggttttggtgatagaagggattgagtttggaagtgataaatatgttaagtttgatgttcatattgatgatgatgaagataatttgagtgaaccggatcagacagagtttgtgggaacttttgttaatttgttccatggacaaggccataatatcaacactagttttaaggtagggatatcgaaagtgctggagtgtttagaagctgaagaagatgatgttgtgctggttactttggtgcctaaggttgggaaaggagatgtcatcataggaggcatcaaaattgagtttattccaaagtag

SEQ ID NO: 4536 - DNA, 1479 bp, Glycine max var. Williams 82
atggaagctcaatcacaccaccgactcaatgtcctttttcttccatatccgacacctggccatttacttcctatggtagacacagcaagactatttgccaagcatggtgttagtgttactattctcactacccctgctattgcttcaacattccaaaatgccatagacagtgacttcaattgtggatatcacatcagaactcaagtggttccattcccttcagcccaagttggtctcattgatggacttgaaaacatgaaagatgccactaccctagaaatgttggttaaaatcggttatggactatcaacgctccaagatgaaattgagcttcggtttcaagaccttcaaccagattgtatagtgactgatatgatgtatccttggacagtggaatcagctgaaaaactaggcattccaaggattttcttttacagctcaagctacttctccaactgtgcttctcattttatcaggaagcatagacctcatgagagcttagtctctgacagccacaagtttacaattcctggtttgcctcatagaatagagatgaccccttcgcagctagcagattggatcaggtctaagactcgtgctacagcctatttagagccaacttttgaatcagagagcagaagctatggggcactgtataatagttttcatgaacttgaaagtgagtatgagcaacttcataagaacacattggggataaaatcttggaatattggaccagtttcagcctgggttaacaaggatgatggagaaaaggccaataggggacacaaggaggaccttgcagaagagccagaattgctaaattggcttaactctaagcaaaatgagtctgtactttatgtaagttttggaagcctcacaaggctccctcatgctcaacttgttgaactggctcatgggcttgaacattctggtcatagtttcatctgggttataaggaaaaaggatgagaatggagacagttttcttcaagagtttgagcagaagatgaaagaaagcaagaacggttatatcatatggaactgggcaccacagttgctgatattggaccaccctgcgataggaggcattgtgactcactgtggttggaattcaattcttgaaagtgtgagtgctggattgccaatgatcacatggccaatgtttgcagagcaattcttcaatgagaagttgctagttgatgtgttgaagattggagtcccagtgggagctaaagaaaacaaattgtgggcaagcatgggcaaggaggaagtgatgggaagggaagagattgcaaaggctgtggtgcagtttatggcaaaagaagagagcagagaagtgaggaagagagcaagagagcttggtgatgcttccaagaagagtatagagaagggtggatcctcttaccacaacttgatgcagttgttagatgagctcatctcattgaagaaaactaggacatgtgagaaaccaaattag

SEQ ID NO: 4537 - DNA, 2094 bp, Glycine max var. Williams 82; identical to SEQ ID NO: 3252

SEQ ID NO: 4538 - DNA, 1815 bp, Glycine max var. Williams 82
atgaaaaatacatgcaacagaaagctgattggagcaagatactataacaaagctttcgaggcacataacggccaactggatccattgctacatacagcacgtgactttgtggggcatggaacccatactctatcaactgcagggggaaattttgtcccaggagcgagggtatttgccgttggcaatggcactgcaaagggtgggtcaccaagagctagggttgcagcttacaaagtgtgttggtctcttactgatcctgcaagttgttatggggctgatgtgttagctgctattgaccaagccatagatgatggtgttgatgtcatcaatgtttcttttggtgtcagctacgttgtcactgctgaaggaatattcacagatgagatttccattggggcattccatgcaatttctaaaaacatacttttagttgcctctgcaggaaatgatggaccaacgcctggaactgttgccaatgtggctccttgggtcttcacaattgctgctagcacattagacagagatttcagcagcaatttaaccattaataatcagctaattgagggagccagtctttttgtaaatctgccacccaatcaggccttttctctgatcctctccactgatgccaaacttgctaatgcgacatttcgagatgctcaactttgtaggcgtggaacacttgatcgtacaaaagtaaacggcaaaatagtgttatgcactcgtgaaggaaaaataaaatcagttgctgagggtctggaagctctaaccgcgggcgcaaggggaatgattttgaacaatcagatgcaaaatggaaaaacactttctgctgagcctcatgttttttccactgtgaacacgcctccaagacgtgcaaagtcaaggccccatggtgtcaaaacaactgccattggggacgaggatgaccctttaaaaacgggtgatacaataaaaatgtcccgagcaagaacgttatttggaagaaagccagctccagttatggcatcattttcatctagaggacccaataagattcagccatcaatactcaagcctgatgtaactgcgcctggtgtgaacattcttgctgcctattcagagtttgcaagtgcatctagcttgctagtagacaatcgtcgtgggtttaaattcaatgtattgcaaggaacttctatgtcttgtcctcatgcttcgggcattgctggacttctcaaaacacgacatcctagttggagtcctgctgctattaaatcagctatcatgaccacagcaaccacactcgacaacactaataggccaatccaggatgcgtttgataaaacactagcagatgcttttgcttatggttctggacatgttcgacccgatctagcgatagaacctgggcttgtttacgatctaagcctcactgattacttgaacttcttatgtgcttccggatacgaccaacaactcatttccgccctcaatttcaacaggacattcatttgttcaggttctcacagcgtaaatgacttgaactacccttcaatcacattgccaaatcttcgcttaaaacccgtaaccattgctcgcacagtcacaaatgttgggccaccaagcacatacactgtaagtacccgctcgccaaatggatatagcattgccgttgtgccaccttccttgactttcacgaaaattggtgaaaggaagacattcaaagtcattgtgcaagcaagcagtgcagctacgcggagaaagtatgaattcggggatttgcgttggacagacggaaagcatatagtaaggagtcctattacagttaagcgcagatga

SEQ ID NO: 4539 - DNA, 339 bp, Glycine max var. Williams 82; identical to SEQ ID NO: 3243

SEQ ID NO: 4540 - DNA, 540 bp, Glycine max var. Williams 82
atggctgaaattgaataccatgcaaaatccaatactaacactcaacccctaaagctctttggcatcaacattagcaagtccccagaagatcaaactcatgaagcaggttcgaattctgagcctttcagttcaagaaagtacgagtgtcagtactgttgcagagaatttgcaaactcacaggcactaggagggcatcaaaacgcgcacaagaaagaaagacagctcttgaaacgtgcccaaatgcaagctgctcgtggttttgtttcttcacagattcacaacacaatcatatcaagcttctcaccacagtctcagccacctttgtcgtggttatgcacaccacatggtggtgcatatcattcaggagctgcctttgtggcttctggaagacgaatctatgttgcagcagctggtgcctccatcactgatggccatggtcaccgccaccctctgccgcagttcggtggcttcaacgggggtgaaggtagtggtggtggtcgtgaacgagggttaggtttggatttgcatcttagcctgtga

SEQ ID NO: 4541 - DNA, 2409 bp, Glycine max var. Williams 82
atgcattgcatagctaattccgaaagggcacttgtgttggaaagaatggacagctccatttttcgccttatagtttcgtcgtgtcttctttttactttcctgctggaagctgttcatggcagcaaaaagtgttacattgtatacttgggagctcattctcatggtcctagccctacctctcttgacctcgaaatcgctacccattctcattatgatttactagcttcagtcttgggaagtgaggagaaagcgaaagaagcaattatttactcatataataaacacatcaatggcttggctgcgctacttgaggaggaagaagcagcagatattgcaaaaaacccaaatgtggtgtctgtgttcttgagcaaaaaacataaactgcacacaactcggtcttgggaatttcttggactagaccgaaatagtaagaactctgcatggcaaaaggggagatttggcgaaaatacaataattggtaacatcgacacaggtgtttggcctgaatccaagagcttcagtgataatggatttggctccgtcccatcaaaatggcgagggggtaacgtttgtcaaattaacaaactccctggctccaagagaaatccatgcaacaggaagctgattggagcaagattctttaacaaagctttcgaggcatacaatgggaaacttgatccatctagcgaaacagcacgtgattttgtggggcatggaacccatactctatcaaccgcagggggaaattttgtcccaggagcgagtgtatttgccgttggcaatggcactgcaaagggtgggtcaccaagagctagggttgcagcttacaaagtgtgttggtctccaactgatcctgcaagttgttatggcgctgatgtgttagctgctattgaccaagccatagatgatggcgttgatatcatcagtctttctgctggtggaagctacgttgtgactccagaaggaatattcacagatgaggtttccattggggcatttcatgcaattgctagaaacagaattttagttgcctctgcagggaatgatggacccacacctggaactgttctcaatgtggctccttgggtcttcacaattgctgctagcacattagacagagactttagcagtaatttaaccatcaacaataggcaaattacgggagccagtcttttcgtaaatttgccacccaataaagccttttctctgatccttgcgactgatgctaagcttgctaatgcgacatttcgagatgctgaactttgtaggcctggaacacttgatcctgaaaaagtaaaacggaaaatagtgcgttgtattagagatggaaaaataaaatccgttggcgagggtcaggaagctctatctaaaggcgccgtggcaatgcttttgggcaatcaaaagcaaaatgggagaacccttcttgcagagcctcatgttttgtctactgtgaccgacagtaaaggacatgcaggggcacagcctggttacataactgccattggggacgaggacgacatccctataaaaacgggtgatacaataagaatgtccccagcaagaacattatttggaagaaagccagctccagttatggcttcattttcatctagaggacccaataagattcaaccatcaatactcaagcccgatgtgactgcgcctggtgtgaacatacttgctgcctattcagaattggcaagtgcatcgaacttgctagtagacactcgtcgagggtttaaattcaatgtattacaaggaacttctatgtcttgtcctcatgtcgttggtattgctggacttatcaaaacacttcatcctaattggagtcctgcagctattaaatcagcaatcatgaccacagcaaccacacgtgacaacacaaataggccaataaaggatgcgtttgataataaagtggcagatgcctttgcatatggttcaggacatgtgcaaccggaccttgccatagatccgggacttgtttatgatctaagcctcgctgattacttgaactttttgtgtgcttccggatacgaccaacaactcatctccgcactcaatttcaatggcacattcatttgtaaagggtctcacagcgtaacagacttgaactacccttcaatcacattaccaaatcttggcctaaaacccgtaaccattactcgcacagtcacaaatgttggaccaccagccacatacactgcaaatgtccactcgcctgctggatataccattgtcgttgtgccaagatccttgactttcacgaaaattggggaaaagaagaaattccaagttattgtgcaggcaagcagtgtaactacgcggagaaagtatcaattcggggatttgcgttggacagatggaaagcatatagtaaggagtcctattacagttaagcgcagatga

SEQ ID NO: 4542 - DNA, 1398 bp, Glycine max var. Williams 82
atggctggagatgaagaaaaacttacaatagtgatgttcccatggctagccttcggtcacatgatcccaaaccttgagttggccaaactcattgctcgaaagggccaccaagtgagtttcgtatccaccccaagaaacatacagcgtctcccaaaaccgtcaccaaatacactcatcaatttcgtgaagcttccactccccaaaatccaaaaccttccagaaaacgcagaagccaccactgacatcccctacgacgtcgttgaacacctcaaagtagcctatgacgccctccaagaacctttaaaacgttttctcgaatcttccaaaccggattggctgttctacgacttcgtgcccttctgggctggttcaattgcttccaagcttggcatcaaaagcgctttttacagcatctgcactccacccttctcggggttcttaggacccccttcgtctctcatgggtaaagattcgttacgccaaaaaccggaagatttcatcgtttcccctccgtgggtcccgtttccgacaaccgtcgcatttcggtacttcgaaattatgagaattgtagacagtttgtcggccgaaaacaacaccggcgtatccgacgcgtaccggtacggtgccagtgctgagaactgtgacatcgtggtgattagaggatgcaccgagttccaaccggagtggtttcaagtgctggagaatatttaccggaaaccggttctccccattgggcaactccctagtactgaccctgttgggggtgaggataccgacacgtggcggtgggtgaaggattggctggacaagcatgcgcgtgggagcgtggtgtacgtggcgtttggaagcgaagcgaaaccaaggcaggacgaagtgacagagatagctttgggtttggagaaatcgaagcttccatttttctgggcgctgaggcttcagcgtgggccgtgggacccagatgtgttgcggttaccagaagggttcgaggagcggaccaaagcgcttggagttgtgtgcaccacttgggcgccgcagttgaagattttggggcacatggcggttggtggcttcttgactcactcgggttggacctctgtggtggaggctattctgaatgagaagccgttggttctgttaacgtttttgtcagaccaaggaataaatgcgagagtattggaggagaagaaaatgggctattctgtgcccagaaatgaaagagatggattgttcacgagtgactcggtagctgagtcactgaggctggttatggttgaagaagaaggaaggatctatagggaaagaattaaagagatgaaggacttatttgtgaatagagaaagacaaaatatgtatattgataatctcctacgcactcttacaagctcattgaaatgttaa

SEQ ID NO: 4543 - DNA, 1080 bp, Glycine max var. Williams 82
atggggaattccgttctctttatctctttcttcatcttcagctttggtttcttggaggctcaaaaggctccagcagtttatgtgtttggagactcacttgttgatattggcaacaacaactacttgagtctctccattgaaaaggcaattcttcctcactatggcattgattttccaactaagaaacccactgggagatttagcaatggcaagaatgctgcagatttaattgctgaaaaattgggcctacctacttcaccaccttatctctccctagtatctaatgtccacaacaacagcaacaacgtatcttttttgcgtggtgttaactttgcctccggaggtgctggaatattcaatgtctcagataatggttttaggcaatcaatacctttgccaaagcaagtggactactactcactagtgcacgaacaactggcacaacaaataggagcatcttctcttgggaaacacctctcaaagtccatcttcattgtggtgattggaggcaacgatatctttggttactttgactcaaaggatcttcaaaagaaaaacacccctcagcagtacgtggattccatggcttccacattaaaagtgctactacagagattatacaacaatggtgcaaagaaatttgagattgctggtgttggtgcaattgggtgctgccctgcatacagggtcaagaacaaaacagaatgcgtttctgaagccaatgacttgtcggttaaatataatgaagctcttcaatccatgttaaaggaatggcaattggagaacagggacataggttactcttactttgatacttatgctgccatccaagacctcgttcacaatccaacttcatacggatttgctaatgtgaaagctgcatgttgtggatttggtgagttgaatgcccaaattccgtgcctgccaatttcgagcatgtgttccaatagaaaagaccatattttctgggatgcattccatcctacagaagcagctgctcgcatctttgtggatgaaatttttaatggaccttcaaaatacatatctcctattaatatggaacagttactggccatctga

SEQ ID NO: 4544 - DNA, 756 bp, Glycine max var. Williams 82; identical to SEQ ID NO: 3163

SEQ ID NO: 4545 - DNA, 1950 bp, Glycine max var. Williams 82
atggagaaaacaatccatcttgtatatttcaaatgccttgttttccttctcatgaagcaagtaatagtgatggcagaacctagagccaggactgtcaatataacatgtaacaataagctagagcacaacaccaccatctttgttccaaattttgttgcaaccatggagaagatcagtgaacagatgcgcaataccggttatggaacagcagttgtaggtacaggaggacctgacaccaactacgggttggctcagtgctatggtgatctctcattacttgactgtgttttatgttatgccgaggcacgcacggttcttccccaatgcttcccttacaatggcggtcgcatataccttgatggttgcttcatgagggccgaaaactatagcttctatgatgagtacatagggccaggagacaaggctgtttgtggaaacacgacaaggaagagcacaagttttcaagcagcagcaaagaaggctgttttgagcgctgttcaagctgcagcaaacaataaagggtatgctaggaaggaggtttttgtggcaggaacaacaaatgatgcagcttatgttctggctaattgttggaggagcttggacacaaggtcttgtagagcttgtcttgagaatgcatcttcttcgatattggggtgcttgccctggtcagaagggagagcattgaacactggatgcttcatgaggtactcagacacagattttcttaacaaggaacaggaaaatggaagttcaggaggtaatgtactggtgatagtggttgcagtagtcagttcagtgattgttttggtggttggaatagctattgtggtttatatccgcaaacacagatatattcaaatgaaacgaagaggttcaaatgatgcagaaaagttagccaagagccttcaccacaatagcttgaacttcaagtattctacactggagaaggctactaattcctttgatgaagctaataagcttggacaaggaggatttggaaccgtttataaaggagttctggctgatggaagagagattgctattaagagattatatttcaacaaccgacatagagcagcagatttcttcaacgaagtcaacataattagcagtgtggaacacaaaaatctagtcagactcttaggatgcagttgttcaggacctgaaagccttcttatatatgaatatctacctaacagaagtctagatcgcttcatatttgataaaaacaagggtagagaactaaactgggacaagagatatgacattatcatcggaacagctgaaggattggtttacctgcatgaaaactccaacattaggataatccacagagatataaaagccagcaacatcttattggatgcaaagcttcgtgctaaaattgctgattttggtttggccaggtcctttcaagaagataagagccacattagtacagctatcgctggaactttgggttatatggctccagagtacctagcacacggtcagttaacagaaaaagctgacgtatatagttttggagtgttactgctagaaataattactggaagactgaacaatagaagcaaagcatcagaatattcggacagtctagttacaatgacatggaagcattttcagtcagggactgcggaacaattaatcgatccatgtctagtggtggatgacaaccatagaagcaattttaagaatgagattttgagagtgttgcacataggacttctatgcacccaagaaatcccttccttaagaccatctatgtcaaaggcactaaagatgctaacaaagaaggaggagcacttggatttggaagctccttccaatccacccttcatagatgaaagtaccatggaactccatgaccaaaatgatgacccattttaccctctcaatgcagaagattcattggctactatgtctcatagctcattttatgccaggtaa

SEQ ID NO: 4546 - DNA, 1881 bp, Glycine max var. Williams 82
atgaactatagccgcgttcatgagatccacgcattcataaaatataccacatgtggtgaagaccattttaacctacgtctagtatttgtaaagacggaacaggaaatggagaagagaaagcgtggaaaaagtgaagaaaaaggagaagagaaatgggtgcatgatgcatctgtggattataagggcagagttcctctccgtgcttccacaggtgtatggaaagcgtcgctttttgtccttgcaattgaatttagtgaaaggatatgccactttgggatagccactaatcttatcatgtacctgactaaagtaatgcatgaagatctcaaaacagcgaccaagaatgtaaactactgggtaggagcaacaactttgatgcctctaattggaggatttgttgctgatgcctacactggtcgatttcgtatggtcctcttttcttccctcttatacctcaagggattaagcctcttgaccatgtctcaattcattccaagtctaaaaccatgcaacaatgagatatgccattggccaaggaaggttcatgaagtggttttattccttgccctttactgtgtcgccttgggaactggaggattcaaaccgtgcttacaaagctttggagcagatcaatttgatgatgaccaccttgaagaaaggaagaagaagatgtcattcttcaactggtggaattttacactttgcacggcaatgctgcttggggcaacagtgattgtttatgttcaagactttgtcagctggggagtatcttatctcatcctcagcatgttcatggctctcactatcattgctttctatgaggggaagcgtttttacaggtacaggagcacagaaggtaaccctttcatgctaattctacaagtactaattgcagcaataaggaaaagcaacttgtcctgtccttcaaatcccgattcattgtatgaattcccaaagtcagagaagtcacaaggaaggcttctaagccatacttgcaggctcaggtttcttgacaaggctgcaatagttgaagggaagtatactgagcatagagaccagaatccatggagattagcaacagtgacaagagtggaggagacaaagcttattctgaatgttattcccatatggctaacttcattaataattggtatatgtatagcgcaaggctcgacactctttgtcaatcaagcagcttctatgaacttaaagataatcaacagcttcaaaatcccaccagcttccatgacatctgtttcagctattagcccaataatagctatcccaatatatgataagattatagttccaattatgaggaaagtcaaaggtaacgaaaggggcatcagcgtcctttggagggttggcattggcttagcattcttagtcatagccatggtggttgctgccttagtagaaacaaagagattaagaatggttgaacatgatgaagtgataacagtaggggggactaggcatgagacaatgagtgtgttgtggttgataccccaatacttgatccttggaattggagcagattcattgtctctaattggtttgcaagagtatttctatgaccaagttcctgactcagtgagaagcttaggagtgggtttgtatcttagtgtggttggagtaggattcttcttaagcagttttctgatcatcactgtggatcatgtcacggggaagaatggaaaaagttggattgcgaaggatataaattcaagtcgtctagataaattttattggatgttggctgtcataaatgctttcaatttgtgtttctttctattcttggcaaaggggtacacttataaaaccgtgcaaaggaaaactagggaaatttgtagtgatggggtggagacaatggaatcatga

SEQ ID NO: 4547 - DNA, 1503 bp, Glycine max var. Williams 82
atggaacacttgagcttgaggacacagaaacctgaaatggacccaacggtccttagccacctccactttgttttcatccctttaatggccccaggtcatcttctccctatggtagacatggccaaattgttggcacgacacaaagtgaaagtgagcatagtgaccacacccctcaattgcatccaattccaagctagcatagacagagagattcaatctggctcacccatccaaattctacatgttcaatttccttgcgcggaggctggactaccagagggatgtgagagcctagacactctgccttcaatggatctgctaaacaacttcaacatggctttagacttgttgcagcagccactagaagagctacttgaaaagcaaagaccctacccaagttgcataattgccgacaaatatatcatgtgtgtgactgatgttgccaacaagttgaatgtcccgagaataatattcgacgggactaattgtttctttctactatgcaaccacaatttacaaaaggataaggtctatgaagctgtgtctggtgaagagaaatttcttgtccccggaatgccccacagaattgaattgcgaagatctcaactccccggattattcaatcctggcgcagacctcaagctgaatgcttaccgtgagaaggtaatggaagctgcagaaaaagcacatgggatagttgttaatagttttgaagagttggaagcagaatatgttgaagagtgtcaaagatttacggaccatagggtatggtgtgttgggcctgtgtcgctgtcaaataaggatgacaaggacaaggctatgagaagtaagagaaactcaagtgatcttgagagtgagtatgtgaagtggcttgattcatggcctccgaggtcagtgatttatgtttgccttggtagcctaaaccgtgcaacgccagagcagttgatagagctcgggttaggattggaagcgacaaaaaggccattcatttgggtgcttagaggtgcatatggaagagaggagatggagaagtggctgttggaagatgggtttgaagagagggtgaaagggagagggcttttgatcaagggttgggtgccacaagtgttgatcttatcacatagagcaataggagcgttcatgacacattgcggatggaattccacactcgaagggatttgtgctggcgtgccgttggtaacttttcctctgtttgctgagcagttcatcaatgagaaacttgtacaagtggtgaagattggcgtgagtgtgggagctgaatctgttgttcacttgggtgaagaagataagtctcgggttcaggtgaccagagaaaatgttctggattctattgagaaggtaatgggagatggccaagaaaaagaagagataagggaaagggctagaaagtatgcggacatggcaaggaaagcaatagaacaagacaacgacatggttaaaggcagaaactccctgggagaatcaagcatattaagggtatga

SEQ ID NO: 4548 - DNA, 3330 bp, Glycine max var. Williams 82
atgagatttcatcttgtcctagtatttcctttctttataaccttatgcttcataaactatgtagcaaccagtcactgcctcacacatcagcaatttttgttgctccatatgaagcacaaccttgtattcaaccctgtcaaatcagaaaaactggaccactggaaccaaagtggtgattgctgtcagtggaatggagtaacatgcaatgaggggcgtgtggttggtcttgatttaagcgaacaattcattacaggggggctagacaattctagtctcttcgatctgcaatatctgcaggaattgaatttggctcacaatgacttcggttctgtgattccttccaagtttggcttgctgaaaaatttgaggtacttgaatttgtcaaatgctggctttttggggcaaattccaattgagattggtcttctaacaaagatggctactcttgacttatctacttcgtttactttagagcatactctaaaacttgagaagccaaacataggagtgcttatgaagaacctcacagaaatcacagaactctacctagatggtgtaatggtatctgctactggaaaggagtggtctcatgcattatcttcaatgcaaaagcttcaagttttgagcatgtcatcctgtaacctctcaggaccaattgattcttcactgtcaaagcttaagtctctctcagtgattcaattgaatttgaacaatgtgtcaagtccagtaccagaatccttggcaaatctctcaaatttgaccaccctgcagcttagcaattgtgcattgactgatgtttttccaaagggtatcttccaaatgcaaaagctaaagatccttgatgtgtcatataatctggatcttcatggttccttgccaaacttcacacaaataggatatcttcaaaccttgaatcttagcaatacaaatttctctggacagttaccaggtactatttccaatttgaagcagttggctatagtagatttatctagctgtcaatttaatggaacactcccagtttcattgtcgagactctcccatcttgttcacctggacttgtcattcaataacttcactggccctctaccatctctcactatgtccaataatctcaagtatctatcccttttccaaaatgctctcacaggaccaatcatatccactcaatgggagaagcttttagacctcattagcatcaatttaggcgataactcctttagtggaaaagttccatcaaccctcttcacacttccatcactacaggagcttattctttctcataatggatttgatggtgtgttggatgaattcacaaatgtgtcattctccaatttacaatctgttgatttgagcaacaacaaattacaagggccaattccacagtcatttcttcatcgaaaaagtcttggttacctccttctctcttcaaatcaattcaatggcactatacggttagatatgtttcacagactgcagtatctacagacattaggcctttctcacaacaacttgacagttgataccacttctagtggagaccatggcctttcagcatttcctaatatgacaaatctgcttttggctgactgcaacttgaggaaatttccatctttcttgaaaaatcaatcccaactagtttctctagacttgtccaacaaccaaattcaaggaatgatacccaattggatttggagatttcatgatatggttcacttgaatctttccaacaattttctgacaggcttggaaggacccttggaaaatattagttctaatatgttcatggttgaccttcactccaaccaacttagtgggtctattcctcttttcacaaaaggtgctatcagtctggacttctcaagtaatagattcagcattataccaactgatattaaagaataccttcatttcacatatgtcctgtccctttcaaacaataactttcatggaaaaatccctgaatccttttgtaattgttctactcttagaatgctggatctttcccataatagctttaatggctccattcctgagtgtttgacctcaaggagcaatactctcagagtattggatctagttggaaacaggctaacaggttcaatttctgatacagtttctagttcatgtaacctaagattccttaatctcaacggaaatctcttggagggtaccattccaaaatctttggtcaattgtcagaaacttgaacttctgaacctgggaaataatctattgagtgatagatttccatgcttcttaaggaatatttccactcttcgagtgatgattttaaggtcaaacaaattccatggtcacattggatgtgaacacattggtaaatgggagatgcttcagattgttgatttagcctccaataatttcactggtacactaccaggaacactcttgcaaagttggacagcaatgatggatgatggacctgaagctaaagaaaagtctggcaatttatttttgcacatctatgatttgcatcagtctttgcgttacagggatatggtggtgaaaatggacaaaagtcttgttttgatattaaacaaactgatagtttccttatcttacagaaccattgaaaacttgtactcttattttgtcaattcataccaattgcaatggaaaggagccttcttggattcagttactgttgtcaacaaaggcttacaaatgaagttggtcaaaattcccactgttttcacttccttggatttctcatcaaaccattttgaaggtccactaccagaagagcttatgagtttcaaggcattgatagttctaaacatgtcacataatgctttttcaagccatatcccatcatctctggagaacttgacacaaattgagtccttagacttgtcaaataacaatttgagtggagggattcccacagggattgcaactttatccttcctctcagttttgaatctctcatttaatcatttggtgggacaaattccaacaggtactcagattcagtcttttgaagcagattcctttgaaggtaatgaagggttgtgtggacctccactaaccaaaagttgtattgatgatggggtaaaagggtcaccaacaccaccatcttcaacctataaaacaaaaagttcaattgattggaattttttaagtggtgagttgggattcatttttggcttaggattagtcattcttccccttattttctgcaagagatggaggctgtggtattgcaagcacgtcgaggatttgctttgctggattttccctcagctttattttgtatatgaacaccagggagagaaaaagtacagatgcctaaggtggaagtttagttga

SEQ ID NO: 4549 - DNA, 1518 bp, Glycine max var. Williams 82
atgagaagcacaaaaggtggcgatggtgaaggaaaaagaaactgtggttgttgtggcagattcattgaaggccttcatcaacacttacatcaattccttaaggcacttttccctaccctttctctctctgaggtgaaagaagagttgaaatcactagccaacattgcatgtccaatgatgatgaccaacgtgcttctgtactctcgatccgccatttccatgcttttcttgggtcgccaagggaaagtggagctagcaggaggatcacttgcaatagggtttgccaacatcactgccaattcattcctcaagggtctcaccatgggaatggacccaatttgttgccaagcatatggtgcaaaaagatggtcagttctaagccaaactttttgcaaaaccttgtgcctcctcctccttgttgccatccccatttcactcctttggctcaacatggcacccctccttcattggcttgggcaggaccctgaagtcacaaaagttgcacaagtttacatggtcttctctatcccagaattgcttgctcaagttcatctcaaccctttaaggtcttttttaagaacacaagggttaacaacaccattaactattgctgcttcttttgctgccatcttacaccttccaataaactacttcttggctacatatttggagttaggagtaaaaggcattgcattagccacaggtttgaattccataaacatgatactagggttggtgctttatcttcttgtgtcaaagaaacccttaaaaccttgggaaggtgctactattctctcttccttccatgattggagaccattgctaactctagcattgcctagttgcatctcagtgtgcttggagtggtggtgctatgagataatgctcttcctatgtggcctattgagtaatccacaaaccacagttgctaccatgggtgtactaattcaaacaactgggttcttatatgtgttcccattttcactgagtgctgcattgacaacacaaattggccactccttaggtgcaggtcaaccttcacgtgcacaaatcacagccacaattggactcttcattgcatttgcattagggttctcagcctttgttttcttgctgattgtgaggaacgtgtgggggaaactcttcacaaacgagacacaaattgttgacatggtcacaaccatacttccaattttagggttgtgtgagattggaaactggcctcaaactgctgcgtgtgggatcttgtctgggactgcacggccttatgtgggtgcaaggataaacttgtgtgctttttacttgattggattgccggttgcagtttttgctgctttcatgcacaggtaccaattgaggggcttgtggtttggaatgttggcagcgcaaatttcatgtttttgtatgatggtttacacgttggttcaaacggattgggggcaccaaagtagaagagctgagcaattggctcaagcaactgatgaggaaattagtgggttccttgattctgatatgtga

SEQ ID NO: 4550 - DNA, 990 bp, Glycine max var. Williams 82
atgagtctcaatgtggatgaagatttagtgactgaaatggaggaagcacccactttagctccatctataccattagaaaatgttcaagaaatggtaaggaatgatcctttgcatgtgcctataggatatgtgacgagtcaagaagaattggagaaagccaattatatgcctcacctttcatctgagatccctgtcattgatttagcattgctctcaaatggaaacaaggaggagttgttaaaatttgacgtagcatgcaaggagtggggtttctttcagatagtaaatcatggtgttcaaacagagcttatgcagaaaatgaaggatgcagcatctgagtttttcaatcttccaatagaagagaagaacaagtatgcaatggtttcaagtgagacacatggttatgggaagggttgtgtagtttctggagagcagacacttgactggtcagattcactaatattaatcacataccccacccagtacagaaagcttcaattttggcctaaaactccagagggattcatggagataatagaggcttatgcaagtgaagttagacgagttggggaggaactgcttagttcaatgtcagtgattatgggaatgcggaagcatgttctttttggactacataaagaatccacacctgaacaagtgcagggtttgagtccacattctgacacaagcagcatcaccttgcttatgcaagacgatgatgtaactggcttagaaattcgacaccaaggaggatgggtgccagtgaacccaataccagatgctctagttgtcaatgttggagatgtaactgagcatgacgtggaagttgagccacttgatcatatgatagattctcataaccccaagttgtttcagaaagtaaggtatggagattatttgagacaatctctgaaaaggaagttggagggaaaaacacacctaaatgaggcaaagttaaaggagtctgatctaaggaatcaagatgattaa

SEQ ID NO: 4551 - DNA, 1278 bp, Glycine max var. Williams 82
atgtccaccgatctctctgtcattctccctcgcgttctcattgtctctagacgaagcgttcgcaaaaacaagttcgttgatttcgttggtgagtatcaccttgatcttatagtagggtatggcgcggtgcccgtgattgttcctcgtgtttccggggtgcacatgttgttggatagctttgagccaatccacggcgtgcttctgtgtgaaggagaagacattgatccttcttgttacgaacaagataccgcgggtctttcagaagaggaagtggaagagattagaaggcttcatgcaagtgacacggccattgacaaagagaaagactcaattgagttgagcctcgccaagctatgcctcgagaggaacattccctatttgggaatctgcaggggctcacagatccttaatgttgcatgtgggggtaccctttatcaggacataggaaaagagctttcgattaagtgccctgagggccaaagggctatgcacataaactatgatgattatgatgggcataggcacgatgtggaagtggttgaaaacacccctttgcatcattggtttaaggattctttggaagaaggaaaaatggatatttgtgttaatagctatcaccatcaaggggtgaagagattggcacaacgttttgtgccaatggcctttgcacctgatggtttgattgaagggttttatgacccagatgcttataatccagaagagggtaagttcattatgggattacagtttcaccctgagcgtatgaggaagcctgattcggatgagtttgattaccctggatgcccctttgcttataaggaatttgtaaaagcagttgttgcttaccagaagaagttgaacaatttagcatccgtccaaaagcccattaagcttaataaggaaatggaaatcaaaaggaagattattgtgcgtagtttttcacttgccaaaaacctctacaacactggccgtggaactaattcctccaaacagactgaactcgaagctggagcagaatttcttgagtccaacacagctttgagtgtgcaacaagagaatagattaaaacaaatgggtgcaacggttaggaatgcagggtcctacatagagagactgaagctaaatgaggaaagagaaaaaatggctagaaatctgatggggaaaatgacggtggaacagttgtctgatctcttgtctttttatcacaccatggggcagatttgttccgaagtattggacataaagatacatggccttgtcaatgacttagcttcatga

SEQ ID NO: 4552 - DNA, 963 bp, Glycine max var. Williams 82
atgagggttggaaccagtttccttgcactgctctcattgttgccattgcttctttctccgcaattttcaagtgctcagcttccacctgacactggcatctcatcacgcacccttgatgccattctccaagattgtgcctttaaggcatttttgaggccaaaaactggggtaccctatggtggccaagttcccagaagcctaaatggaattagagtttcagcaatgaggcttaggagtggtagtttgaggaccagaggtgttgaaagatacaaagagtttcagatcccaattggggttgttgagcaaccttatgtggagaggcttgttttggtgtaccataacttaggcaattggtctgagaagttttaccctttgcctggttacacatatttggctcctgttttaggtctaatgccatatagtggtgccaatttgtctgcttctgagttacctgaattggacataagagcttctgataagccaattttgatcaacttccctcatgtgaaatcagcaccattagggtcagtgcccaagtgtgtgtactttgatctacatggttcagtgcaatttgacatcctattacatgggaatgtttgttcaacagtccaacaagggcacttctcaattgttgtggagtctaatgccccttccccagcacctgctgctgcggctgtggctgcggctgcggctgctgatgttaggaaaagtggtagtgggaggaacaagtccaaggtgtgggtaattgttgcatctttggttggtggatgcctcttgttgatcatgttgagtcttttggttgctaaagtgaggagaacaaaaaaagggatgaagattcagcaattggaatgggcagctgagagcaatgaaactttgcagatagcatctattgggggcaccaaagcaccattggcagtagggactcgcacaagaccaacaattgaaaatgattacataccttag

SEQ ID NO: 4553 - DNA, 507 bp, Glycine max var. Williams 82; identical to SEQ ID NO: 3286

SEQ ID NO: 4554 - DNA, 819 bp, Glycine max var. Williams 82
atgaagattgagtttgtccagtttttcactttacattaccaaaagaaagaactaggaagaatgggagttcagcaaaagctcatttctttcctctttcatacttgtcttgttttcattatgttttcccttgtaagctcatcacaagagcaccaccaaattacaagcagcccttcaaaaaccaaagatagcaaccacattaagatgagtcctggacttcagtttcagattacattacatggctttctcctgtgggcttcaatggggttcttgatgcctgttggtatacttgcaattagattgtcaaacagagaggagagtccaaaaaggcatagagttttgttctatgttcattcaattttgcagatgattgcggtgctacttgccaccgctggagcaatcatgtccataaaaaatttcaacaacctcttcaacaatagtcatcaaagattaggagttgcactatatggtgttatctggctgcaagttttacttggcatttttcgaccacaaaggggatccaaaagaagtgtgtggttctttgcacactggatacttggaactgcggtcacattccttggtgtcctgaatgtatatcttggtttaggagcctaccaccaaaaaacatccaaaggcataaaaatttggaacatacttttcactgttcagatatctttgattgtgtttttctaccttttccaagaaaaatgggtgtatatacaaaaccaaggagtggttttgggcaaagaaataaaggctcccatttgtcaagaaagtcgtccagatgaaaaggagaaggtattgaagggtgacacgtgttga

SEQ ID NO: 4555 - DNA, 501 bp, Glycine max var. Williams 82
atgaagatcatccccggcagcaaggccgagccggagaaattctccggcacggtcacggaacacgaaaaccgcaaccgggagacggtaaaattggtgtacaaggcattattgcgtgatgccgacacggagaagcttgcgaaggtggtgagggcagagttggaatggtggtaccacgggcctcctcactgccagcacatgatgaaagtgttgaccggcgagtcaacgacggcgcaaaaggccttcaagtttaggcctcggaggatcagggccgtcggtgaccgcgtggtggttgaagggtgggagggggcgggggagtactgggtgcacgtgtggaggttcaagcacgggatcattactcagctgcgtgagtactttaacacgttgatcacggtggtgcatcgggtttcggaggacggcgatgaggctcgcttgtggcggagcaccaaccgagttcgggttcgggttcacgggtcgttgccggatcttgtgctttccatttga

SEQ ID NO: 4556 - DNA, 537 bp, Glycine max var. Williams 82
atggtcatggcaattgatctgtcaaggatctctgtccggccattcaaggcaagtgaagatgttgacgatgtattgttatggttgggagatgctagagtgactcagaacacacgattaaagacctgtgggtccaggtcagaggctttgacattcctgaaagatgagtgtgttcaccccttacgccggtcaatatgccttgatgatcgttccatagggattgtttgggtgcttccttattcgggtgatgaaaggtacaaagctgacttgggatatgccttagggttcaactgttggggcaatgggatagccactaaggcagtgaagattgttttgtcccaagtcttccatgatttccctcacttgagaaggttgcaagcttatacttatttgcgccacaaggcttcccagagggtgttggagaaggttgggttccatagggaggggatagccacagatttgtactttccggggaagagtgatgattgctatatttttagatttttgtcaacagatgaaattccttctgtgattgtttaa

SEQ ID NO: 4557 - DNA, 2169 bp, Glycine max var. Williams 82
atggctatctctcgtgtacttgctatactcattcttcagtactcattagtagcactagtttcttcagctggaccacgaggtggctggaaaacattgcaaggatctccacctctggtcatagcacgtggcgggttttcagggatatttccagattcaagttcacttgcctatagtttgacactagatacttgtggcccaaatgtgactctatggtgtgatgtgcaattgacaaaggatggtgttgggatttgtttcccagagctcaagctggacaatgcctctgacatttccattgcttacccaggcaaggcaaaggattacttagttaatgaggtctcaacccggggatggttttctgtggactacaacttggcagaactagcaaatgtctctgttgttcagggggtatattctcggactaataagtttgatggtaacaagcttcccattcgcagtgttgaagacgtagctaaattaataaaatcaccatctacaggcctgtggctaaatattcagcatgattcattcttcaagcaacaaaatttgagtgtagaaaattttctgcaatccctccctgctaaaagtgtacctgtcaattacatctcatcacctgatgtggatttcttaagaagagtaaaatcaagctttagttctggaccaactggcttcatcttccggtttctcgagcagtctaaacttgaacctacaaccaatcagacttatggtgaactcttgaaaaatctcatgcttatcaagacatttgcttcaggaattcttgttcccaagggctatatatggcctgtagactcaggcctttatctacaaccacatacccctcttgtcactgatgctcatagagaagggctgcaagtttttgtatcagaccttactaatgatgttccatttagctacaatttcagctatgatcctctggctgagtgtctatctttcatcgatggtgatgatttttctgttgatggtgtgctgtctgacttcccagtaactccatctgcagccataaattgcttttctggcctaggaaaaaatgccaaaaaacaagtggacactttggttatcacaaaatatggagcaagtggagataatcctgcgtgtactgaccttgcatataatcaagctaaatcagatggggcagatgtacttgactgtcctgttcaaatgtccaaggatggaatacccttttgcttaagctctatagatctatcagagagcacaacagttgctgatacacaattgaaaaaccgtgcaacgactattcccgagattaaatatcgcagtggcatatatacattcagcttgacatgggatgagataaaaacattgactccctcaatattgaacccttatgagaaatacatattgtcccggaatccaaaatccaaaaatctaggaaaacttataaccttgtctgactttttgtccctgactgaaggctctcgcatcttgattagcatagagaatgcagcctatcttgctgagaagcagaatttacgtgtgactgatgcagtccttgatgctttacagaaagcaaaaccaagatcacataaagttatgattcagtcaactcatagctctgtgcttaaaatattcaaagataaatccaaatttgaaagggtttacaaggttgatgagaacattggcggtgcagctgactcggccattgaggacatcaaaacatttgctgatgctgttgttataggaaaggcatctgtttttcctgaaagttcagcctttctagttaactttacaaatattgtggcaaggctaaaatcatttaagctcccagtttttgtagaaactttcagcaatgaatttgtatctcaagcatgggactactactcagatccatccattgaaataaattcatttgtcattggaaccaaggttaatggcattattactgacttccccaagacagcaaatagatacaggaggaacttgtgtttaaagcatggcaatgaagcaccttatatgagccctattgaacctggcaaactttttaaacaaatttctaacttgtaccttccaccacttccccctcctctcccaatcttgactgatagtaatgtgacagaggcacctttgcctggtgtctctggaagagttccaactcctggagtaggagtagctccagcccccattacagcataa

SEQ ID NO: 4558 - DNA, 1164 bp, Glycine max var. Williams 82; identical to SEQ ID NO: 3187

SEQ ID NO: 4559 - DNA, 1536 bp, Glycine max var. Williams 82
atggcagtggaaaatatcaaagtccacgaagagtccaacgttgcccctccaccatcatcaacacaatcactatccctccctttcactttgtatgacactttgttcctcaggttcccttccattgactggatcttcttctattccctcaatgctcaacaatcagaaccttctttcttctatgccaatgtgattccaaagctcaaagcctctctctctcacaccctcctacactaccctcctctcgctggcaacattctttggccttctgattccacaattccaatcatcagttacacccctggtgatgccgtttccgtcgttgttgctgagtccaatgctgaattcaaccacttcatagattactcagtgccccatgaagcaacagagtctcgttttttagtaccccacttggaatcctcggattctcgtgcttctgccctagctcttcagatcactcttttccccaacaaaggcttcagcattggcatcagcatccaccatgctgctgttgatggaagatcttccaccatgttcatcaaggcttgggcttctctgtgccaacaaattattatgaactatgaaacaacatcacaaagtgtggtggtgccatctttggtgccggagttggagccttcctttgacagaacactcatcaaagacccgggaaattggaaccgcttcttgttagcaaaatggtgccctaatattgctaatggaaacagtgatggtgatgataatgggaagcgaaccgtgaagattctaccttccccaccaagactcaaggaagcgttttcagccacgtcagtgattaaaccaacaattgaggaagcagttagagccacgtttgttctcacacgagaggatttggagaagataaagaaaagggtcttctccaagtgggaccaagtgaaagacccagaaccagaaccagaatcagaatcagaatcaaaatcaacggttaattcttcttcaaagccaccaactttatcatcctttgttcttgcatgtgcatattctgttgtgtgtattgcaaaagcggttcacggggttgaaaaggagaagcaaaagtttggtttctggttcccggtggattatagggctaggttagagcctccaatccctgatacctattttggaaactgtgtgtggagccacttggtggatgcagaacccttggacttcataaaggaagaagggctcgtccttgttgcaaaaagcattaacagaaaagtgaagaccttacacaaggaagaagttttcggtaaatcgtcttctcggttcatggctttggctaaagaaggagctgaaatgttgggagtgtcgatgtctaacaaatttatggtttatgagactgattttggttgggggaagcctgctaaggtggacattataaatttggatagggcttcgaatttgaccatggggttgttggacagcaaggatggggatggaggtgttgaagtggggctcgttatgcatcagaaggtgatggatctctttggtactatttttcatggaggactgaaagatgagtga

SEQ ID NO: 4560 - DNA, 1137 bp, Glycine max var. Williams 82
atgagttcgtgttgcttagagaaagagaaccatgtggtggaaactgccaccccacaaagagaagacactgatattatcctggatgccatggtgctcggttccaatgtggtctttcctgccgctctcaacgctgcaattgagctcaaagtgtttgagatcattgggaaggaaagctcagaagagagtggtggattcatgtcaccccatgaaattgcttccaagttgttattaccaacacaacaacaccactctgacttgccaaataggcttgagcgtttgttgctcttgcttgctagctactctcttctcactgtttccactcgcaccgatgagaatggtagcgccgtgagagtttatgcggtctcaccatcgggtaaatatttcgtctatgataaaaatggtggtggctatcttgcttcattcacatcatttctgtgtcaccctgcgatgttaggagtatggttgaattttaaggaagcgattattgatcctgagattgacctattcaagaaggttcatggaatttctaagttcgagtactttgggaaagaaccagaactaaaccacgtatttaacaaagcaatgaatgatgtatgcacaacccatatgaaaaaaatacttgaagtatacacaggatatgagggtatatcaactttggttaatgtagcaggtggaactggacaatgtctcaaattgatcatctccaaatacccttcaattaagggaattaattttgacctcccacatgtgattgaaaattcaccacccattccaggggttgagcatattgggggaaatatgtttgaaggtgttccacaaggtgatgccataatgctaaaggccatatgccataattggtcggatgaaaaagccatagaacttttaagcaattgtcacaaagctttgccaccaaacgggaaggtcattgttggggatctcatagtgccagaagatccagaacctacaaatgattgcaaaatgatttcaattcttgataacatcatgtttattacacctggtggaagggaaagaactgagaaacaatttgaaagtttgggcaagcgttctggattttctaggtttcaagttgtttgtcgggctttctctactatggcagtgatggaattttacaaataa

SEQ ID NO: 4561 - DNA, 1929 bp, Glycine max var. Williams 82
atggtgcaacacaacttgcctttgcccatcaaatcttgcacccccaagaaactcccgaacgccccaatttcagtttctaaggtgagggtcatcgtcagagtcaggcccttcctcgcacacgaaacctcatcaagaaacggcgttgtttcgtgcatctccgtcctggaccaagatttcgaatctccgcaggacgaggttactgtttatctcaaagacccactaaccagccggaacgagtgctacctgttggactctttctttgggcaagaagataacaatgtgggccagatattctgcggagaagtgagccccttgattccgggaatgttcagcggatgcaattccacggtgtttgcttatggggctactggcagtgggaagacatacaccatgcagggaaccgaggaacaacctggcttgatgccactggcaatgtccatgatcctgtctatttgccagaggactgacagcacagcacagatctcatactatgaggtctacatggaccgatgctatgacctcttggaggtcaaagcgaaggagatttcagtttgggatgacaaagacgggcaaattcacctccggggactatctcaggttcctataaacacaatgtctgaatttcaagatgttttctcttgtggagttcagagacgcaaagttgcacatacaggcctcaatgatgtctctagtaggagtcatggagtgcttgtgatatctgtgtccactctttctgctgatggcacaggaactgttgcatgtggaaagttgaatctcatagacttggcaggtaatgaagataacagaaggacatgtaatgaagggattcgtctccaagagagtgccaagataaatcagtcattgtttgcgctgtcaaatgtgatatatgcattgaacaacaataaaacaagggtaccctaccgagaaagtaaattgacccgtatattgcaggactctctaggcggaacaagtcgtgcactgatgattgcttgcctgaatccaggagaataccaggaatctgttcatactgttagtttagctgctcgatcaaggcatgtctctaattttgtgccttcaggtcacaaacaagagaccccaaaagttaaagttgacatggaagcaaaattgagagcttggctagaatcaaaaggcaaaacaaagagtgcacaaagacttgggccattaaattctccacttccaaaaaaaacacccagttctattgttactcctgctaagagatccattacctttaacagttcagtgaagaagtgggggaaaactgccaacctagatgctcaacatactaatgaaagggcctttgctgtagcttttggaaatttactagatgttgaaggctcttttcattcatgcatggagaatgcaccatctggtgtcaaggacaatgataagaaagagactgagcatgatgccaataaggctgcaaggaaatcatacaaaagtctacctgttgagtcattgagcaagggagtggactcaattactattgatggtaaagatgcagcacaaagtccattaagaaaagccctctcccccatcaacatcaatggtaatgagaaaccccttgaatcacaaacaccttttctggcaacctgctccactaataaaggggcacaaaagaatgacactccacttggcaaattcagcacacgaagttctacactgaagaactgtctagttcaagaatacattgatttcttgaataatgcaagcagagaggagctactagagttaaagggtataggagagaaaatggcagaatacataatagaccttagagaagaaagtcccctaaaatcgttaaatgatttggagaagataggcctctcttccaagcaggcccataacttgttcacaaaagctgcaaaaacgctatttgaagataaagctgaagattcaatactcggttga

SEQ ID NO: 4562 - DNA, 894 bp, Glycine max var. Williams 82
atggagtacatgaaccagagaccaaaatatgattgccttctttttgatttagatgatactttgtatccactaagcactggtcttgcaaaagcatgtggccaaaatattaaagactatatggtggaaaagcttggcatagacaaaagcaaaattgatgacttgtccaacctcctctacaagaactatggaacaactatggctggtttaagggcaattggatatgactttgaatatgatgaatatcacagttatgttcatgggagattaccttatgagaatttgaaaccagacccagttctgaggaaccttttgctgagcctgccctataggaaactgattttcacaaactcagacaaagtccatgctgttaaggcactaagcaagcttggattagaagactgctttgaaggaatcatatgctttgagacccttaatcccatccacaaaagttctgtctctgatgatgaagacgacattgagtttgtggggggttcaggcacaacaattccagcaccaaaaaaagatgttaatagctttcaaatctttgacctcattagccattttgctaagcccaatcccaacacagttttgccaaagacaccaattatttgcaaaccatcagaaaatgccattgagttggctctcaagatagccaaccttaatccacagagaactttgttctttgaggatagtgtccgcaacatacaagctggaaaacgtgtgggtcttcacactgtgctggttggaaaatctcagagaattaaaggagcagattatgcattagaaagcatccacaaccttagggaggcagtaccagaactatgggagggtgacataaaatcagaagttgcttatcctggcaagcattctgtggagacatctgtgactgcttag

SEQ ID NO: 4563 - DNA, 1497 bp, Glycine max var. Williams 82
atgaagacagaatctcaaccccagcaactgaatgtaatttttcttccatatccagctcctggccatatgaaccccatggtagacacagcaaggctatttgccaagcatggtgttggtgttaccattatcactacccctgctaatgatttgactttccagaaagccatatatagtgatttcagttgtggaaactgcatcaaaacacgtgtgattcaattcccagcatcccaagttggtctccctgatggggttgaaaatgtcaaaaacgtcacttcaagagaaatgttggacaaaatcagtcttggactattgattctcaaagatccaatagagcttctgtttcaggaaatgcaaccagattgtatcgtgactgatatgctttatccatggacagtggagtctgctgcaaaactaggcattccaaggctttacttttacagctcaagctacttcacaagttgcgctggtcattttgtgcggaagcataagcctcatgaaaggatggattctgataaccagaagttttcaattccttgccttccacataacattgtgattaccactctgcaggtggaagaatgggtaagaactaagaatgacttcacagatcatttgaatgctatatatgaatcagagagcagaagctatggaacactgtacaacagttttcatgaacttgaaggtgattatgagcaactttatcagagcacaaagggggtcaagtgttggagtgtaggaccagtttcagcctgggttaatcagcgtgatgaagaaaaggccaataggggacacaaggaggagcttgtgctagagtcagagtggctaaactggcttaactctaagcaaaatgattctgtactttatgtaagttttggaagcctaatcaggctccctcatgctcagcttgttgaaatcgctcacgggcttgaaagttctggtcatgatttcatctgggttattcgaaaaaggtgtggagatggggatgaggatggtggagacaatttcctgcaagattttgagcaaaggatgaatgaaagaaagaagggttatatcgtatggaactgggtgccacagttgctgatattgaaccaccctgccattggaggtattgtgactcactgtggttggaactctgttcttgaaagcttgagtgctggtttgccaatggtcacatggcctgtatttgcagaccaattttacaatgagaagttggtagttgatgtcttgaaaattggagtcccagtgggatcaaaagagaacaagttctggacgcgtattggtgaggatgcagcagtgagaagagaagtgattgcgaaggctgccattctgctgatgggaaaagaagagggtggagaaatgagaaggagagcaagaaaacttagtgatgctgccaagaagactatagaggagggtggatcctcttacaacaacttgatgcagttgttggatgagctaaaatcattgaaaatgtcaagagaacttgagaaaacaaattag

SEQ ID NO: 4564 - DNA, 1311 bp, Glycine max var. Williams 82; identical to SEQ ID NO: 3194

SEQ ID NO: 4565 - DNA, 777 bp, Glycine max var. Williams 82
atggctggaatggttcccctttgcattgcatcattggtcactctttttgttgcaacaagtgctagaattcctggggttttcaatggtggtgcatggcagggtgcccacgccactttctacggtggaaatgatgcctctggaacaatgggtggggcatgtgggtacgggaacctatacagccaagggtatggcgtgaacaccgcggccttgagcacggcgctgttcaacaacgggttgagctgcggcgcgtgcttcgagataaagtgcgaccaagatccgaggtggtgcaacccgggaagcccttccatcgtcatcaccgccacgaatttttgccctcccaactttgcccttcccagcgacaacggcggctggtgcaaccctcctcggccccacttcgacctcgccatgcccatgttcctcaagatcgctcagtataaagccggcatcgtgcccgtcagttaccgccgggttccatgcagaaaggtcggtggaataagatttacgatcaacggttttcgttacttcaacttggttctaatcaccaacgtggcgggtgcaggggatatcgcgcgcgtgagcgttaaaggttccaaaaccgggtggaacagcatgagcagaaactgggggcaaaattggcaatcaaacgcgaatttagtgggccaggccctttccttcagagtcacgggcagtgacagacgcacctcaacctcttggaacgtggcaccttctcattggaagttcggccagaccttcacgggcaagaatttccgcgtctga

SEQ ID NO: 4566 - DNA, 471 bp, Glycine max var. Williams 82
atggctctttcaccactcagcatgcttgtggtcattgccaccatcttcctcccatccgttgctgtggccaaggaattcgtagttggtgatggtcatggatggacaataggctttgattatgcagcttgggctgcagataagaccttccaagttggggatgtacttgtattcaattatgctgttggagaacacaatgtgttcaaagtgaatggaactgcattccagagctgcacgattcctccagcaagtgaagcattgtctactggaaatgaccgtattgtattggcaattcctggcagaaaatggtacatatgtggtgttgaagatcactgcagtgctggccaaaagcttgttatcacagttcaaccccaaacactgcctccaactctaccaccatcacctactcctgcaccttcgcctcgtcaacatcgtcctcattttggtcgatgggtgcctaatatttttcattaa

SEQ ID NO: 4567 - DNA, 1140 bp, Glycine max var. Williams 82
atgaaggacaccacggccggcgccgccgtggagaccgccgcaggctacggcatcaagccgtcgagctccgatggcagccaccttttggtgagaagggccatgcaattcaccatgttcgttgttgggtttgctgtgttgtggatgtttctctataacactgcctctccctttggattccatggcttctcgcattacttcattgatgagtcagcaaaagctggatatgatccgaagctacaaagtgttcttagaaacgcatctatgaaggataagacagtgataatcacaactctaaatgatgcatgggcagagccaggttccatatttgacctctttcttgagagttttcacctagggaaccagacaaaaatgtttttgaatcacttggtggtaataacttgggaccaaaaggcacatgctcgttgcctagctttgcacaagcattgttaccaagttgaaactaaaggtgacaatttcaccggtgaagcttttttcatgactgcagactacctacacatgatgtggagaagaattgaattccttggtacagtccttgatatggggtacaacttcgtgttcacggatactgatataatgtggcttagagatcccttcaaactattttacaaagatgcagatttccaaatagcatgtgattttttcaatggcaatacctatgacttaaacaactctccaaatggaggctttaattatgtgaaatcgaataaacgaactatttcgttctacaagtattggttcaactctaggaatgcctacccaaagttgcatgaccaggatgtcctcaacaagataaaaaagaactccttcatttccaacatgaagctgaagattaggttccttagcactagttattttggagggttttgtcagcatgcaaaggacttcaacaaggtctcaacaatgcatgccaattgttgtgttggtttagataacaaagtcaatgatctcaaaattttgcttgaggattggaagaagtacgtggcattgcctgaaaatgagaaaaatcagtcgcatccttcttggagcgtaagttgcaggacgtcctttggacgtgccaaacaaaggaagcagaagaataaagggtggttacgacgacgggcattggctgtaactgtttga

SEQ ID NO: 4568 - DNA, 1092 bp, Glycine max var. Williams 82
atgggaaccccacaatccaataacttgccaccagggtttaggttccaccctacagatgaagagctcattcttcactacctaaggaagaaggttgcctccattcctttgccagttgccatcattgctgaggttgatatctacaagtttgatccatgggagctaccagctaaggccgcgtttggggagaaagagtggtacttcttcagtcctagagaccggaagtacccaaatggagcgaggccaaacagggcagcagcttcagggtattggaaggccacaggcactgataagaacatagtggcatcactggcaggaggagtgagggagcactttggtgtgaagaaggctttggtgttctacaaaggaaaacccccaaagggtgtcaaaaccaattggatcatgcatgaatatcgccttgttgacaccaatagacccattaggatcaaagacacctccatgaggttggatgactgggttctatgccggatatacaagaagttcaagcatgctgtatctccaaccacagaggcagcatcaacactgcaagtgatcaatgagcaattagatcaagcagtggtagaagaagaggagcaaatcaaagacacccttttaccaattttgaagaataacaacacttttgtccctcctccacaagccacaatactcatgtctcagaaatccttatccttctcaaatctcttggatgccacagactactccatgcttagcaccatcttatctgagaaccactccaataattaccctactccaagtgaaaccagcttattcaataattgtgagaatctggatcaggaaattaccccccaaaactactacatcaacgatactaatagtattaataataatagctacttgtttcagaagaacccttccaacatggaaaacattgctaggccaaaacgccaccttccaaacatggatcatgaggacaacatgttattataccctttaaagaaatatcatagttcctcttgcaatttccccaacaccaacctccaaaaccagaatccacaatggaacttcatgttcaagcagccactcatgagtcctcaatatcttcaatttcagtga

SEQ ID NO: 4569 - DNA, 2238 bp, Glycine max var. Williams 82
atgacctccaccaccacctccacctccaccgaccccctccccttctcctccgacgccggcgccctccgcgccatcaacaaacgcttcgagggcctcctgaccgtccgcacaaaggccatgaagggcaaaggagcctggtactgggcccacctggagcccattctggttccccaccccgacaccggcctccccaaatccgtgaaactcaaatgctccctctgcgactccctcttctcctcctccaacccctcacgaaccgcttccgaacactttaaacgtggtacatgctccaacttcacctcctctctcagacccccttctccactccctatttcctccatcacccccgctccccgcaagcgtccctcccccgccacctcacctccttcctatcaaaatcactccttgcccattctccactcttcccacttccaaatctctcacgccaatactgcacactcgcataatcaccaccaccaccaccagcatttaatgttgtctggtgggaaagatgacttgtgtgctcttgcaatgtttgaggacagtgtgaagaagctaaaaagtcccaagacttctcctggtcctgctttgagcaaggaccaggtgaattctgctttggacttgctcttcgactggttctatgaaaactccgtgtctttgtccatgatcgagcaccgaaagtttcaggcctttttgagccaggttggcttgcccaacaagttggggagggagatttctggggagaggcttgatgctaggttcgtggaggccaaggctgagtccgaggctaggataagggatgccatgttttttcagttggccagcgacgggtggaagtgtggggattggtttaacttggacttttgttgcggtggtgattgtggtggtgtaggcggcggggagagtttggttaagtttgtggtgaatctccccaatgggagtagtgtgtttcagaaggccgtgtttaatgggggagtggagaattccaagtacgctgaggagaggtgtgtgggtattgtggcggacaagtttaaggcgaaggcgttgaggaacttggaggtgcagcaccattggatggtcaacacagcttgccagcttcaggggttgactagcttgatcaaggattttaactgtgagctgccgcttttcagggttgtgattgagaattgtttgaaggttgctaattttatagacaatgagttgcatgtgaggagtgttttcctcaagtacaggatgcaggagatggactgtggtgggttgattcgcgtgccttcgccgaaatgtgatccgttgaagaactttggagtggcgtttcctacgttggaggatacgttgagctgtgctagagtgatacagagggtggtgatggaggatgggtttaaggtgatgtgtatggaggatccactggcgagggaggtcgcggggatggtgcaaaatgaggggttttggaatgagttggaggctgtttattcgcttgtgaggctcgttaaagggatggtgcaggatgttgagacagagaggcccttaattggtaggtgtttgtctctttgggaggagctgaggagcaaggtgaaagagtggtgtgggaagtacaacattgtggaaggacatgcggagaagatagttgaaaagcggtttaggaagaattatcaccctgcttgggcagcagcgtttatacttgatccactttacttggttaaggatgctagtgggaagtatcttcctccgtataagtgtttgacgcgcgaacaggagaaggatgtagataagttactgacgaggctggcttcccgggaagaggctcatgttgtgttgatggagctaatgaagtggaggtcagaggggcttgatccgctctatgcacaggctgttcagatgaagcaaaaggatccagtaaccggaaagatgaaagttgctaatccgttaagtagtagacttgtctgggaaacatgtttgagtgaatttaaatccctgggaaagattgctgttaggctcatttttctgcatgcaacttcaagtgggtttaagagtaactcgtctttcactaggaaagtttcagctaataaacactcaagagttaccttggagagggctcagaaaataatatatattgcagctcatgccaaacttgaaaggagagacttttctaacggagaagagaaggacgcagagctgtttgtcatgtccaatagtgaggatgacatgcttgaggtttatgctgatgctcccttagtgtaa

SEQ ID NO: 4570 - DNA, 1266 bp, Glycine max var. Williams 82
atggcacaacaatattcatcctcaagttggagctgcaatttatccaagatggcagggcttgccttgtgcctccttgtgatgttgagctatgcaagttcttcatatgctcgtttgttgttgaatagaacaagaggagggttcatggtgtctagagaggcacataggagaaacctgcttgataatggacttggccatacaccccccatgggatggaatagctggaaccattttgcctgcaatattaaagaagacttgattcgagaaacagccgatgctatggtgtcaactggccttgctgctctaggataccaatatattaacatagatgattgttggggagagctcaaccgagactcaaagggcaatttggttcccaaagcctcaacgtttccttcaggaatgaaggctctagctgattatattcataaaaaaggtttgaagttgggaatctattctgatgcaggaaatcaaacatgcagtaaaactatgcctggatcactaggacatgaaaaacaagatgcaaaaacatttgcttcctgggggattgactacttgaagtatgataactgtgagaataacaatataagccccaaagaaaggtaccctccaatgagtgaagctttggcaaacactggaagaccaattttcttctctttgtgtgaatggggatcagaagatccagcaacttgggccaaaagtgtgggaaatagttggagaacaacaggagacattgaagataagtgggaaagtatgatatctcgtgcagatctaaatgacaaatgggcttcttgtgctggacctggaggatggaatgatcctgacatgctagaagttggaaatggaggcatgacaacagaagaatatcgcgctcatttcagcatatgggcattagctaaggctcctttattgattggttgtgacattagagcattggatgccaccacaaaagaattgctaagcaacaacgaagttattgcagtaaaccaagacaagcttggagttcaaggaaagaaggtgaaaagtaataatgatttggaggtttgggcaggtcctctcagtaataacaaggtagcagtgatcttatggaatagaagttcatccaaagcaaaagttactgcatcctggtctgacataggcctgaaaccaggaacttcagttaaagcaagagatttatgggcgcattcaacacaatcatctgtttcgggagaaatatcttctgaattagattcacatgcttgtaagatgtatgtcctaagtcctaactaa

SEQ ID NO: 4571 - DNA, 945 bp, Glycine max var. Williams 82; identical to SEQ ID NO: 2972

SEQ ID NO: 4572 - DNA, 933 bp, Glycine max var. Williams 82; identical to SEQ ID NO: 2988

SEQ ID NO: 4573 - DNA, 2061 bp, Glycine max var. Williams 82; identical to SEQ ID NO: 2889

SEQ ID NO: 4574 - DNA, 996 bp, Glycine max var. Williams 82
atgagagcattgagattgaggaattgtgtgtatcttcctctcttagctttcttgatcgtgtcggtatgtttcctactatatcactaccctagatcacttgaaaggggagtcacaaaggtggttctgctcaagcatagatcaacttattactcagaaaatgaagaattggataatgtactgtggagtgctaaattgccagacagaacagttatcctaaccatggtagatgaatcaatggcaagtcctggatctatccttgacattttactacagagcttcaaatcaggtgaagggaccgaaagattgctgaatcacttggtgatcatatccatggacccccaagcttttgagtactgcagttccttgcacccctattgcatccatccctccatatttccacgtcccattatgacaaccccagatcataatttattcacttggacaagaaatgatgttttgtatgaagtgattcgattgggttacaacataattttcacggatgcagatgtactgtggcttagaagtccgtttataaacttccatgcggctagtgaactcacaatttcatgtagtgatggacaaagtggaagtgacctgcaggatggggggatcttcttcttgaaagcaagtgagaattcccttgaattcttcaagtattggaaattgaccaagttcctgcatccaaacaatcccgcagaagagtccttgtgtacaacagtaagtgtaatgcaggatgcagttagccggtatagctttgatgttcagcttgcaaatacaagctcttttggtgatttttgtcagctaaatatgaacacgttaagggaggcttataccattcaagctaactgttgtgatgatctcaaaagcaaagttcatgacctgaggattgttcttgatgattggatccgcttcagaaaacgtgcatcagagggcaatgctttggacaaaatggatttgaggtggccacagaagtgctccataagaaactatacttag

SEQ ID NO: 4575 - DNA, 2820 bp, Glycine max var. Williams 82; identical to SEQ ID NO: 2909

SEQ ID NO: 4576 - DNA, 3291 bp, Glycine max var. Williams 82
atgggtctccacgcccgccgttacgactctgctaccggcaccgtccctccgctctcccccaccatcttcatcccccctccccagctcctccaccaccatgatccctaccctaattccctctttgatcagtcctacaacgctggtagccacaaccgccacgaatcgctccccggcccctccttccttcccctctcgccgcctccgaccactgttcattcccgccgcgactcctaccccggccccttcccttcccccacattcactgaatctgattccctcctccttccttcaacctcatcaccgtccatcaaccactattatcatcgtgagctttattatcctaccagcaaacgcaggttgtgtctctatgacaaggacagcaacctcgcctggccatttggcgagcttgaaggtctcgaccatgatgacataagggaaactgcctatgaaatcttcttcacggcgtgccggtcctcaccggggttcggcggccaaagcccgatcacgttttattctaagcatgatgcatgcaatggcgatgggaggagcctgccggtgtcccagacaagtagggtgaagcaagcgcttgggctgaggatgctgagaagctccttgtctcggaggataatggtgtcggcaccggcatcgccggtgactgagcggagtcctcggtctcaggccgtgccacggaggaccgtgacaatggcggaggttatgaggctgcagatgggggtgtcggagcagagcgatagccggctgaggaaaacactcatgaggacgcttgttggccaacttggccgacaagcagaaactatcattctccctttggaactccttcgccacctaaagccttcagagttcaatgattcccatgagtaccatttgtggcaaaagaggcagctcaagttccttgaagtaggtctcctcttgcacccttcaattcccatacaaaagaccaacacctttgccatgaaccttaaggaaattatacgtagcgccgaattcaaacctttagacactggcaaaaactcagacaccatgagaaccttcagcaactctgtggcttccttatcaatgagaagccctgatgatactcccaccaatgtttgccactgggctaatggatacccagtgaacattcacctctacatttccctccttcagtccatttttgatctaagggatgagacatcagtgcttgatgaagtggatgagcaacttggtctgataaagaaaacatggtcaacactggggatcaataggccaatccacaatgtgtgtttcacatgggtgatgtttcaacaatatgtagaaactgggcagatagaacctgaccttctttgtgcctcacatacattattgaatgaggtggcaaatgatgctaagaaagaaagggagtccttgtatattgagatattgaaatctgtcctcagttcactgcaagagtgggcagataaaaggtttcttaactaccatgagtattttcagggaggtgatattggacaaattgaaaaccttctccctgtggtgttattagcatccaagattttgggagatgttacaaattctgaagaaaggcaagaaaaaggagaaaaaactagagcgaattcctctgagggccggattgatgactatatctgttcttccttgaaaaatgcttttgaaaagatgatggaagcagcaaatgccaaatctgctgagtctgaaacaaagaaagaaataggtgaagttatgcttcaattagctcaggaaactgaatatttggcattgaaagagagacaaaattatagtccaattttgaagaaatggaacacaatagctggtgcagtagcagcattgacactgaacaattgctatggacatttgctaaagcagtatttaagtgaaatgaccacatctataacagttgaggtagttttagtactgcagagggctaaaattctagaagatgttttggttcaaatggtagttgaagactcagctgattgtgaggatggtggcaaaacagtagtgagagagatggttccatttgaagttgagtcaaccataatgatccgtattagaaaatggatagatgaatcactgcacaaaggaaaagagtgtttgcagagagcaaaagaatctgaagcatggaatccaaaatctaaatcagagccatatgcaaaatcagctgtagagcttatgaatttggccaagaagattgtgcaagaattctttcaaattccaataccaataactgaagttttagttcaagaacttgctgatggattacaaaaaatcttccgggagtacacaatgtttgttgctgcatgcggtttgaaagagaactacattccgtctcttcccccactgaccaggtgcaacaggaattcaaagttccacaagctgtggaagatagctagcccctgcagtgttagttgtgaagatccacacatatatggaatatatgaagctaatcatcctcactcatgcacaagccgtggaacacagcgcctctacattcgtctcaacaccttacactacctcctttctcatatcccctcacttgacaaatcactctccctgaccccaggagttgttccttctaaccgtcactgtttcacaagcagcgacaagactcatagtaacagaacttcatactttgaaaccaccaacaccaccatcctagcagcctgccagcatgtctcagaagttgcttcctaccgtctcacgttctttgacacaaacccttttttctatgacagcctctatgttggcgatgtagccaatgctaggattagccaattattgacaattctcaagcataacatcaaattaatgacagcaattctgacagaaagagctcaagcaccggctgcgaaggaagttatgaaggcctccttcgatgcattcctcacagttttgcttgctggtggaaccaccagggtgttcaatgaatcagatcatgaaagtattagagaggattttgacagtttgaagcagctattctgcagttttggagaagaattgatagcagaaactgaggtggagaaagcggctgagatagtggagggagtgatggcactaatgggaatgagtactgaacaattgatggaaaacttaagtaccttatcaaatgagacaagtggaataggagtcattggtaatgctcagaagttgccaatgccaccaactacaggaaagtggaatagagcagaccccaacacaatattgagggtattgtgctatagaaatgatcgaactgcaagtaacttcttaaaaaggacattccaaatagcaaagaggagatga

SEQ ID NO: 4577 - DNA, 1425 bp, Glycine max var. Williams 82
atgaaagacaccattgttctataccctaatcttggtaggggacacctagtttccatggtggagttgggaaaactcatactgacccaccacccttcactttccatcactattctcatcctcactcctcccaccaccccttccaccaccaccaccaccttagcctgcgactctaatgctcaatacatcgccaccgtcaccgccaccactccctccatcacgttccaccgcgttcccctcgccgcactccccttcaacacccccttcctcccccctcacctcctctccctcgaactcacccgccacagcacgcaaaacatcgccgttgcactccaaaccctcgccaaagcttcgaacctcaaagccatcgtcattgacttcatgaacttcaacgaccccaaagccctcactgaaaatctcaacaacaacgtccccacttacttctactacacttctggcgcctccactctcgctttactcctttactaccccaccattcacccaaccctcatagaaaaaaaggatacagaccaacctttgcaaatccaaatccctggattatccacaattacagccgatgattttccaaacgaatgcaaagaccccttgagttacgcttgccaagtcttccttcagatagcggaaaccatgatgggtggtgccgggattatagtaaacacatttgaagccattgaagaagaagccatcagagcgttaagtgaggatgcgacagtaccaccacccttgttttgtgtcggacccgtgatttctgcaccgtatggagaagaagacaaagggtgtctgagttggctaaacttgcaaccgagtcagagcgtcgtgttgctgtgtttcggaagcatgggaaggttctcgagggctcagttgaaggagatagctattgggttggagaagagtgagcaaaggttcttgtgggttgtgagaaccgagttgggtggtgctgatgactcggcggaggaactgagtctggacgagttgctgccagaagggtttttggagaggaccaaggagaagggaatggtggtgagggactgggccccacaggcggcgattctgagtcacgactcggtgggtgggttcgtgactcactgcggttggaactcggtgttggaagcggtgtgtgaaggggtgccgatggtggcgtggcctctctacgcggagcagaagatgaacaggatggttatggtgaaggaaatgaaggtggctttggcggtgaacgagaacaaggatgggttcgtgagttcgactgagttgggggaccgagttagggaactcatggaatcagacaaagggaaagagattcgtcagaggattttcaagatgaaaatgagtgctgcggaagcaatggctgaaggcggaacatcacgtgcttcgttggataagttggctaagctgtggaaacagagttga

SEQ ID NO: 4578 - DNA, 957 bp, Glycine max var. Williams 82
atgacttccttctctctaaatattggcaatttcatcactttcatactcacccttacaaactacccactatggtgtgaacaagccttagcattagcagaaagtcaagacttggttggtcaccttacaaataatgatccagcccctcctcaatacaccacaccaaattccaatgacacaacaaacatagaaaattttgttccaaaattaattgacgaattcattgcttggtgcaagacagatcgtcttcttcgagggtcgataattggaacattgcctatgctgtttggactgcacttaaagattcatatgcggaagactcgcaagaacatcacatatctccgcaaggaagatgatcaaagtattggtgaacacatccgcactttcaaaggtttatgcaaaaaccttgttgcaattgggaaacatgtcccagacaaagagaaagttttctatctcctcacaagccttggaaacgagtatgaaccattcacaacaaccatgataaaacctccaaggccatcatactctgagttaatctcacaactccaaagtcatgatcaacgtcacaattggttctcccatcattccaatacgcacaactcttccactcctcaagtggctttctatggtgaacaacaacgatctcgtcaattttcctctcaacatcaaaggaattctcaaaccttcacatcaactgggagaggatttcaggctcaaccacccaataaccaaaataaaagccaaatccttatgagcacacaacagagatgtcctccaccaccgggacaacggtgtatgactcttacagaacgagaacaatatcagaatgaaaaatgtcaatactgtgataaaatgggccatgtagcaaagatatgttggtgggtgtccaagaaaccaactcaatctgatgatatacctcaagcacttgcaacccttaccttagacaacacaattgcttaa

SEQ ID NO: 4579 - DNA, 585 bp, Glycine max var. Williams 82; identical to SEQ ID NO: 2920

SEQ ID NO: 4580 - DNA, 3522 bp, Glycine max var. Williams 82
atgagtggtggcaggaggaggaagctgcgcttaagcaagatctactcatttgcatgctgcaaggcatcttttgagggagatcatcattcacagattggaggaaaaggttattccagagtggtgttctgcaacgagccagatagctttgttgaggacggtgttaagaattttgcagacaattcagtcagatcaacaaaatatactcttgccactttctttcccaaatctttgtttgaacagtttaggagagcggcaaacttctattttttggtcactggcaccttggccttcacaaaacttgctccatacactgctgtcagtgctatccttccactgattattgttattggggcaaccatggtgaaagaaggtattgaagacttgtgccggaaaaaacaggatattgaggtgaacaatagaagagttaaagtgcataaagctgatggtatttttgaatatactgcatggaagaatgtgagggtggggaatatagtgaaggttgagaaggatgaattcttcccagctgacctcctgttactatcatccagttatgacgatgcagtttgctatgttgagaccatgaacttggatggggagacaaatttaaagttaaaacaagggttagaggtaacttcttccttacaggaggatctccatttcctaaattttaaagctacagtgaaatgtgaagatccaaatgcaaatttgtactcatttgttgggagcatggactttgaagagaaaaataatgccctttctcctcagcaacttcttctccgcgactctaaacttcgtaatacagactatatttttggagctgtcattttcactggtcatgacactaaggttattcaaaattctactgacccaccttcaaaaagaagcagaattgaaaagaagatggacagagtcatctatttcttgttttgcattttattcctaatggcatttgttggatctattttctttggcattgcaactaaagatgactttcaaaatgggttgatgaaaagatggtatttaacaccagatgattctactgttttctttgatccaaaaagaccagctgctgctgctttatttcattgtttgacagccttaatgttatatgggttttttattcccatctctttgtatgtgtcaatagaaattgtcaaagtccttcagagcattttcatcaatcaagatatccatatgtactacagggaagcagacaaaccagctcgagctcgtacttcaaacttgaatgaggagcttggccaagttgatacaatactttctgataagactggaactcttacctgcaactcaatggagttcattaaatgttcaattgctggggtagcttatggccgtggtgctacagaggttgagaaggccatggatagaagaaaaggttcaccatcaattcatgagcatgatattgaatcagaagcagataacattaggggttcgctagataaaagggcactcattaaaggttttaactttgctgatgaaagaataacaaatggaaattgggttaatgagcctcatgcagatgttatccagaagttttttcgcctattggtggtctgtcatacagccataccagaagtggatgaagagacaggtaatgtctcatatgaggctgaatccccagatgaagcagcatttgtgattgcagcaagagaacttggttttgaattttacaaaaggggtcagactagtttattgacatatgagttggatccagtttcttgcaagaaagttgaaaggaagtacaagcttctcaattgtttagaattcaatagctcaaggaagcgaatgtcagtgatagtggaagatgaagaagggaaaattttgcttctctgcaaaggtgcagacagcatcatgtttgaaaggcttgccaagaatgggagggagtttgaagagaaaaccatggagcatgtgcatgagtatgctgatgcaggtctacgaacccttatactagcctatcgtgaacttgatgcagaagaatacaaggagtttgataataaattctctatggcaaagaatttagttagtgctgatcaggatatactgattgaggaagtatcggaaaagattgagaagaacctaattcttcttggtgccactgctgtagaggacaagctccaagatggggttcctgaatgcattgacaagcttgcccgagcaggaattaaaatttgggttttgacaggggataaaatggagactgcaatcaatattggttttgcttgtagtttgcttagacaaggaatgaagcagattataattcatttggatagtccagaaattcaagcactagagaaggatggagacaagatggctattgcaaaggcatcaaggcaaagtgtactccttcagatatctgatggtgctgcacaactcactgcatacagagggagctctcatcaggcctttgctctgattattgatggaaaatcacttgcttatgcattagaagataatatgaagaacatgtttctggagcttgcgattcgctgtgcatctgttatttgctgtcgctcatcaccaaagcagaaggcaatggtcactagattggtcaaatctggagccaggaaaacaacattagctattggtgatggagctaacgatgtgggaatgcttcaagaagcagatataggggttggtataagtggtgttgaaggaatgcaggcagttatgtctagtgatattgcaattgcacaattccggtatttggaacggttacttctggtgcatggacattggtgttaccggaggatctcatctatgatatgctattttttctacaagaatatcacatttggttttactctattcttatatgaggtgtatgcatcattctctggacaagctgcatacaacgactggtttttgtctctctataatgttttcttttcgtcacttcctgtgattgcacttggggtatttgatcaggatgtatccgctcggtactgcctgaagtttcctttgttatatcaagaaggagtacagaatgttcttttcagttggcgtcgaatactcagctggatgcttaatggatttatcagtgccttaataattttcttcttctgcacaaaagcgatggagctccaggccttcgatgtggaggggagaactgctggaaaggatatactgggagcagcaatgtatacttgtgtagtttgggttgtaaacctgcaaatggcactagctgtaagttacttcaccatgatccaacattttttcatctggggttccattcttttgtggtatctttttctcgtggtatatggagcaatgcccccacacttttccacaaatgcttacaaagtcttcattgaagctcttgctccatccccttcctattggattgtgacactctttgtggtgatctccacccttataccatacttctcatacgcagcaattcggatgcggttctttcccatgtatcatgaaacagtgcaatggataaggtatgaagggaagattaaggatcctgagtttttgtcggttcaacagcacgcatag

SEQ ID NO: 4581 - DNA, 3090 bp, Glycine max var. Williams 82
atggcttggcgatcattctcctacgatgtgttcctcagcttccgaagggaagatactcgtcatggtttcactggcaatctctacaatgtccttcgcgaaaggggaattcacaccttcattgatgacgacgagccccagaaagcggaccaaatcacaaaagcacttgaggaagcaattaagaactccaagattttcatcatcgtgctctctgaaaactacgcatcttctttcttttgcttaaacgaactcactcacatccttaactttactaaggggtgggatgatgtgttggttttgccagttttttataaagtggatccttcagatgtccgacaccatagaggtagttttggagaagcactggctaatcatgaaaagaacttgaactctaattacatgggcaagcttaagacctggaagatggctctgcgccaagtttctaacttttctggccatcatttccaacctgatgggaacaaatatgaatacaagtttattaaggagatacttgaatcggtgtctaacaagcttaatggtgatcatttatatgtttcggatgtcctggttgggctagagtcacccttgctagaagtaaaggagcttctagatgttggacgtgatgatgttgttcacatggtggggatccatggactccctggagtgggtaaaacaacacttgctgtcgcggtctataattccattgttgatcattttgaagcttcttgctttcttgaaaatgtgagagaaacttccaataaaaatgggttagtacatctccaaagcgtccttctttctaaaacagatggagaaattaagttagcaaattcgagagaaggaagtaccataatacagcgtaagctcaagcaaaagaaggttcttctgattctagatgatgttgatgaacataaacagttacaagcgattattggcaaccctgattggtttggtcgtggtagtagagtcatcatcaccactcgagacgaacatttgttagcgcttcacaaagttaaaataacatatgaggtgagagagttgaataagaaacatgctcttcaattacttactcagaaggcttttgagttggaaaaagaagttgatccaagttaccatgatattttgaatcgagcgataacttatgcttcaggcctcccattggctctagaagtaatgggttccaacttatttggaaaaagtatagaagaatgggaatctgctctagatggatatgaaagaattcctgataaaaagatctatgacatacttaaagtaagctatgatgctttgaatgaagatgagaaaagtatttttcttgatattgcttgtggcttcaaagattatgaattgacatatgttcaagatatactttatgctcattatggtcgttgcatgaaatatcatattggggtgttggttaaaaaatctctgataaacattcattgctggcctactaaggtcatgagattacatgacttaatagaagacatgggtaaagaaattgtcagaagagaatcaccaacagagcctgggaaacgtagcaggttatggtctcatgaggatataaatcaagttttacaagaaaataaggggactagaaagattgaaatcatatgtatgaatttttcctcatttggagaagaagtggaatgggatggagatggcttcaagaagatggaaaatctgaaaacacttattatcaagagtgattgtttttccaaaggtcccaaacatcttcctaatactttaagagtattggaatggtcgagatgtccttcacaggaatggccacgtaattttaacccaaagcaacttgctatatgcaagttaccccatagtagcattacgtcactcaggttggccccattatttaaaaagaggctcgtgaatttgacaagtttaattttggacgagtgtgatagttttagatggataccagatgtatcttgtctctcaaatttggaaaatttgtcatttagaaagtgtcggaatttatttacaattcaccattcagttggtttattggaaaagcttaaaatcttggatgctgcaggttgcccaaagcttaagagttttccaccgttgaagttgacctctcttgaaaggtttgaattttcgggttgttacaatctcaagagttttcctgaaatattaggaaagatggaaaatatgacacaactttcctggactggttgtgccataacaaaactcccaccttcatttcgaaatcttactcggcttcaattgttagttctgacaacttttataaaatatgactttgatgctgccaccctcatttcgaacatctgcatgatgccagaactaaatcaaattgatgctgccggtttgcaatggaggctattgcctgacgatgttttgaaattgacctcagtcgtgtgttcaagcgttcaatctcttactttggaactgtcagatgagcttcttccgctatttctctcatgttttgtaaacgtgaagaagttgaacctatcatggagtaaattcacagttattcccgaatgcatcaaagaatgccgctttttaactacccttactttggattattgctatcgtcttcaagaaattagagggattcctccaaacttgaaaatattatctgcaatggattccccagccttgaattcctcaagcataagcatgttgctgaatcaggaactgcatgaggctggagacactgactttagtttgccaagagtacagattccagagtggtttgagtgccatagttggggaccaccaatttgtttctggttccgtaacaaatttccagccataactgtttgcattgttaagctaaatttaagttatcagttgctcagcgtgatcattaataataaaccggaatatgtatataataaacatggaattattgatttttaccgtggcaccttcagacattctacatatgtttttcgtcttcaaatggaagataatttagatgaagaactatcaaagagtgaatggaaccatgcacagattgtatgtggtgaagagtcgtgggacgaatgcggaatccatgtattgaaagagcaaagtagcatggaggatattcgattcactgatcctagcttttag

SEQ ID NO: 4582 - DNA, 720 bp, Glycine max var. Williams 82; identical to SEQ ID NO: 2970

SEQ ID NO: 4583 - DNA, 1362 bp, Glycine max var. Williams 82; identical to SEQ ID NO: 2948

SEQ ID NO: 4584 - DNA, 606 bp, Glycine max var. Williams 82
atgggaaaagttcacccccaagcactaaattcctatactacttgcaatttcacttgcaagcaagagacttttaccctatggatgaaatctctggtactgaacggaaaaggatgcaccgtgtttgattcaaatggccaaattgcataccgagttgataactacaactgcaagcatagagatgaagttcatctcatggatcaaaatggcgatattttgttcactatgttgaaaaagcaatataagttatccaggttttgggagggttatagatttccagttccagcaacaaggaatgaccacaaaagaccatgctttcgagtttcaaaaacttacaagatctctagaggtggttcaacctatgaagttgaacttggattggacaaaaatcaaccgtatactcataaaatagaacgcaacactttcaactcagcttgcaaaatatctaatgagcttggagtggtagtggcagagctaaggagaaagaagtcaccttgtggagttgatttaggagacgatgttttgacgatggtggtggagccaaatatagatctttctctaattatggggcttgttgtagcctacaatcttataaactgtaaaatttga

SEQ ID NO: 4585 - DNA, 3276 bp, Glycine max var. Williams 82
atgggcagtcactttctcaaaattttgtttgcagtgttagtatcccttcttggattcaactggccagcacagagttcacatgtgaaatgcatagagaaggagaggcaggcactactcaacttcaaacaaggcctcatagatcactctagcatgctgtccacatggagggatgatgacagtaacaaagattgctgcaattggagaggcattgaatgcaacaatgaaacaggtcacgtacaaatactcgatcttcacggttcgaatacgcattttttgactggtctaatcgatctcacttctttgatttacttgcaaaatatggagtatttggatctcagttcgaattatgattccaataaaagtaaactccctgaacacctgggctctttcagaagcttaagatatctgaatctatcatatatgaattttgatggggagattccttgtgaaataggaaatctctcaaagttggagtatcttgatcttaaagtaagttctctccggggaccaatcccttctcagctagggaagcttacatgtttacgatatctagatttaaagggcaattatgatctccatggagaaatcccttatcaaattgggaatctctcactgttgaggtatcttgatcttgggtttacttcactttccaaagcaatccctttgcatgttgggaatcttcctatcttgcatactcttagacttgctggcagttttgatcttatggttaacgatgctaagtggctatcttctctctcttccttaacaaattttggcctggattcaatgccaaatcttggctcctctggtcactggcaacaaatgattgctgagcttattccaaacttaagagagctgagactagttcgttgtagtctttctgatcatgatatttcatcgttgtttcgttctcattccaacctttccacttctctttccatccttgacctctctgataatatgctgacatcatcaacatttcaattgttgttcaactatagtcataatctccaagagcttcgtcttcgtggtaataatattgatttgtcgtctcctcaccatccaaactttccctcccttgtggtccttgatctcgctgttaatgacctgacatcatcaataattttaggaaatttcaacttcagctccaccatacaagaactttatctagaagagtgcagttttactgataaaagttttcttgttccatctactttcataaaaaagtcttcatcttctcttgtcacccttgatctctcctctaatctattgaaatcattggctatatttcactgggtttccaacttcaccaccaatcttcatacactttctcttgatcataacttgttagaaggtcccattccagatggatttgggaaagtaatgaactctcttgaagttctaaccctttcctctaacaaactgcaaggtgagattccagcttctcttggaaatatatgcacattacaggaattagacattagcagtaacaacttgagtgggaaaatttatagctttattcaaaattcttcaattttgtcgtctttgaggagattagatctttccaacaataaattaacgggtgaaataccaaaaagcattcgtttgttatatcagttggagagtcttcacctagaaaagaattatttggagggtgatatcaacgaattgcatctcacaaatttgtccaaattgatggaattagacttaacagacaactcattgtctctaaagtttgctacttcctggattccatctttccaaatatttcatttgggactaggttcttgcaagttgggacctagtttcccaagttggctccagactcaaagtcagttaagctttctagatatttctgatgctgagattgatgactttgtaccggattggttttggaacaagttacagtctataagtgagttgaacatgtctagcaacagtctcaaaggtacaattccaaatctaccaatcaagctgactgatgttgatagatttataactctaaattcaaatcaacttgaaggtgaaattcctgcttttttatcacaagcgtacatgttggatctttccaaaaataagatttcagatttaaatctgttcttgtgcggaaaaggtgcaaccacaaaaatcgacacattggatttgtcaaataatcaaataatgggacagctgcctgactgttgggaacatctaatttcattagcatatcttgatctaagtgataataaattgtcagggaagattccacagtccttgggtactcttgttaatttgggagctttggccttacgaaacaacagtttaactggaaagctaccattcacattgaagaactgcacaagtttatatatattagatgtgggtgaaaatttgttgtctggtacaataccatcatggattggaaaaagtctacaacaattggaaatcttaagcttgagagtaaatcgcttctttggaagtgttcctgttcatctctgctatttgatgcaaattcatctcttagatctttcaaggaatcacttgtctggaaaaattccaacatgtctgaggaattttactgcaatgatggaaagaccagtaaacagatctgaaattgtagaaggctattatgactctaaggtctcattgatgtggaaaggccaggaacatgtgtttttcaatcctgagtatcttttaatgagcattgatctctcaagtaacaacttaacgggtgaaataccgacagggtttgggtatttacttggattagtttctttgaatttatcaagaaacaacttaaatggagaaattcctgacgagattgggaatttaaatttgttagaatttctcgacttatcaagaaatcatttctcaggcaaaattccttctactctttccaaaattgatcgtctttctgtgttagacttatcaaacaacaatctgattggaagaatcccccggggaagacagttgcaaacctttgacgcctctacttttggaggaaatcttggtctttgtggggagcaacttaacaaaagttgtcctggagatgagacaatagcaaagcctcaaggactagcaattgatggtgaagatgacaattcaattttctatggagcattatacatgagcttggggtttggattcttcacaggcttttggtgcttattggggacaatactactttggcaaccatggagaattacttatatgagattcttgaacagactgacagactatatacttgtaacaatggaagtaaatatggggaagtgctataggtggctcacaggctag

SEQ ID NO: 4586 - DNA, 1407 bp, Glycine max var. Williams 82
atggtacttgtgctatggtcaagagggactaagaacatggacttcctaaccctcttcactcttctactcttgttattcattcatacagcactctcttctacccaatatcatgatgggaacatcttactcactcatcgtaagatcttccccaaacaggaagctatcacctcgtacgctgtcatctttgatgctggtagcactggtagccgtgtgcatgtcttccatttcgaccagaacttggatctccttcgtattggcaacgaactcgagttttatgataaggtaacacccggtttgagtgcatacgcagataatcctcaacaagctgcagaatctcttatcccacttttagaggaagctgaaagtgttgtccctgaggacctgtaccctactacacccgttaagcttggggcgactgcaggtttaaggcttttggaaggggatgcttctgaaaggatattgcaagcggttagggatttgctcaagaacagaagtaccctgaacactcaaccagatgcagtagctattattgatggaacccaagaaggttcttatctatgggtgacaattaattatttattggggaagttgggaaaaaggttttcaaagacagtaggagtagttgatcttggaggtggatcagttcaaatggcatatgccatctcaaggaacacagcaaaaaatgctccaaaaccaccagatggagaggaaccttacataaagaagcttgtactcaagggaaaggaatatgacctctatgttcacagttatttgcattacggtagagaagcatctcgtgccgagattttgaaggtcactgatggctccgctaacccttgtattttagctggcttcgatgggacctacacatattcaggagcagactataaggccttcgctcccatttctggctccagctacgatgaatgtagagaggttgttcttcaagctctcaaattgaatgagtcatgcccccatcaaaattgcacatttggtggtatatgggatggtggaaggggaagtggacagaaaattcttttcggcacttcatctttctattatctgcctacagagattggtatcattgatctaaataaacccaactccaaaattcatcctgttgatcttgagattgaagctaaacgagcttgtgaaacaaaattggaggatgccaagtccacctatccaaaccttgctgaggatagacttccatatgtatgcttggatattgcataccagtatgcattgtacaccgatggatttggccttgatccatggcaagagattacagtggcaaatgaaatagaatatcaggatgctcttgtggaagctgcatggcctttaggcactgccatagaagccatatcgtcattgcctaaatttgatcgattaatgtattttatttaa

SEQ ID NO: 4587 - DNA, 3156 bp, Glycine max var. Williams 82
atggctttgggatcatgttcctcttccttcaactatgatgttttcctcagcttcagaggcgcagacacacgacatggttttaccggaaatctttacaaagctcttgatgacaggggaatctacactttcattgatgatgaggagctccagagtggagaggaaataacaccagcacttctgaaggcaattcaagagtccaggattgccatcactgtgctctctataaattatgcttcttcctcattttgcttagatgaacttgcctacattcttgagtgctttaagagcaaaaatctgttggttgtgccagtcttttataacgtggatccttctgatgtcagacaccagaaaggtagttatggagaagcattggctaagcatcaggaaaggttcaaccacaacatggagaagttggagtattggaagaaggctctgcatcaagtagctaacttgtctggctttcatttcaaacacggagaagggtatgaatatgagtttattgggaggattgttgagttggtctccagcaagatcaatcatgctcctttgcctgttgcggattacccggttggactagaatcaagattactagaagtaacaaagcttttggatgttgaatctgatgatggtgtctacatgatagggatccatggaattggtgggataggaaaatcaacacttgctatagcagtttataatttgattgcttgccattttgatggttcatgttttcttaaagatttgagagaaaaatcaaacaagaaggggttacaacacctccagagcatccttcttcgggaaatacttggagagaaggaaatcaacttagcaagtgttgaacaaggagcttcaattatacaacataggcttcagcgaaagaaggttctcttgattttagatgatgttgacaagcatgaacaattacaggctattgttggaagaccttgttggtttggtccaggcagtagagtcatcatcaccactcgggacaaacaactgctagcatctcatggggttaaaagaacatatgaagtggaactattgaatgagaacaatgctcttcaattgcttacatggaaatcttttaaaaccgaaaaggttgatccaagttataaggaggtcttgaatgatgtagtaatttatgcttctggccttccattagctttggaagtgataggttccaacttgttcgggaaaagcatagaagaatggaaatctgctatcaaacaatataaaagaattcccggcattcaaatcctagagatacttaaagtaagctttgatgctttggaggaagaacaaaagaatgttttccttgacattgcctgttgcttcaatagatatgacttgacaaaggttgaagatatacttcgtgctcattatggtgattgcatgaaatatcatattggagtgttggttgaaaaatctcttataaaaaagaagtttagttggtatggtagagtacctagagttacaatgcatgacttgattgaggacatgggaaaagaaattgtcaggcaagaatcaccgaaagagccagagaagcgcagtagactatggttaccagaagatataattcaagttttggaagacaacaagggaactagtgaaattgaaatcatatgtctagacttcccctgctttggcaaagaagaaatagtagaattaaatacaaaggctttcaagaagatgaaaaacctcaaaacacttattattagaaatggtaaattttccaaaggtcccaaatatcttccaaacaatttgagagtactggaatggtggagatatccttcacattgtttaccatctgattttcatccgaaaaaactttccatatgcaagttaccctatagttgtatttcgtcatttgagtgggatggcttatggaagatgttcgtaaatctaagaacattgaattttgacgggtgcaaatgtttaacacagattcctgacgtatctggtctcccaaatttggaggaattttcatttgaacactgccttaatttaattacagttcacaattcaattggttttctggataagcttaaaacattgaatgcttttagatgcaaaaggctcagaagttttccacctatcaagttgacctctcttgaaaaacttaatctttcattttgttacagtcttgagagttttccaaaaatattaggaaagatggaaaacataagagaactttgtttgtcaaactcttccataacagaattgtcattttcatttcaaaatcttgctgggcttcaagcattagacctgagctttttaagtcctcatgcaatttttaaggtgccaagtagcattgtcctgatgccggaactgactgaaatctttgtcgtgggattgaaagggtggcaatggctaaaacaggaagagggtgaagaaaaaacggggtcaatagtatcttccaaggtagtaaggcttactgtcgcaatttgcaacctcagtgatgaatttttttcaatagattttacttggtttgcacatatgaaggaattatgtctatccgagaataatttcacaatccttccggaatgcatcaaagaatgtcaatttttaaggatacttgatgtatgtgactgcaagcatcttcgggaaattagagggattccaccaaacttaaagcatttctttgcaataaactgtaaatcattgacttcctcaagtataagcaagttcctaaatcaggaactgcatgaggctggaaacactgtgttttgtttgccaggtaaaaggattccagagtggttcgatcagcaaagcaggggaccttcaatttctttctggtttcgtaataagttccctgacatggttctttgtcttattgttgcacccattcgatcccaattttttcgtcccgaggttttcatcaatggcaatgaatgttccccttatagttgctatttccagaaaggaatgcaccatgcatatctttgtgatctacgagagatagaattcagaaacagtccgtatgaggtgcctttcgaaaatggatggaaccatgtgaatgttacatgtcctcgttgtatagatacctatatccaccctgttaaaatgggaatccatatatttaaacaggaacatgccatggaggatgttcgatttactgatccttttatagcaagagaaaatcagacgatgatgtag

SEQ ID NO: 4588 - DNA, 642 bp, Glycine max var. Williams 82; identical to SEQ ID NO: 2965

SEQ ID NO: 4589 - DNA, 1290 bp, Glycine max var. Williams 82
cttaagcttgctgttaggatcatcgatctttggttcgttgggactcctaacaagtctgagcaagcggaaatggtttttgttgattctgagggtgatcaaattcatgctatttgtaaatcggaccacctcaagtcttggaaagctgatttgaaagagaattgcacttatgttatgcataatttcaaagttgttaagaatgatggtcaatttagagtgtgcgaacatgagtacaagttattttttattggagtgacggttgttagagaagctgatttgcaagaactttcttttaaggaatttagatttgttgaatttgcaaatgttgttgctggcaattttgtgtctggcctgttggttgatattattggggtcattgatcaggtggtctttcagcatgtttcatcgaaaaataccagggttgtttttagaatgaaggatttgagtggtgaaattttgtcttgcacactttgggagaattactgtgctcagttcctatcctatttgaatgaacgaagttatccagcttcagtgagcaattccttcaaggcgttaaaactattgattaatgatcctatattagaaattcaggaatttaaagagagctcacaagtttcaagggggagtcagctatcatcaaaggattcgtttctttcaaaggttgaagccaaaactattttagaaatcaatgccatttctgaggacgctgtttgtgttaccgtggggactattagcaaaatagtcatggataaccattcatggtattatccagcctgtgctcaatgtcataggaaaactgacatccaaacaggaccattcacatgtggatgtgacaaggataatgatcaacctgttctaaggtatagagttgaggtcatggttacacaaaacaatgagagtggcaaatttttgctctgggaccgtgaatgtgctaaattgattggccaaacagctgatggtgtgaatagggtcaagattgaagatggtgatcttgatttgaatgctttccctcatgcactcgacaaattgttgggtcatgtgcttgcttttaaggtcaggattcaatcaagattaaaaaatgtagttgtacttaaatactcaaaagacctggatttgatcaatgttgttctggagatgctgcctgatattgaccatgatcccgttgtgaggttgcctttaacacccaaaaagcggatgtcatctgatgaagccgatgatgacttagggagctctcaaatttcgccagctcagctatcatctaacaaattaacaagacattctcataggagctaa

SEQ ID NO: 4590 - DNA, 1008 bp, Glycine max var. Williams 82
atgtctctatggaattcaccttcttcaacatctcgagttcagagtcctcaaaatacccctataattcctgctagctgctctccaaaactcgtgaaacgaatgcaacaagaaacctgttacaaatgtgatcaacgaggacattggtcttattactgtccttacaaatcccccaaaactaaacccatctcaccctcacccaagcaagattccacagtttcctacaaaagggctcatggatcttgtgggtacggtgtgactgaggatgaattgctcaatggcaatagcaacagcattgctcgtttaaagcaaagcaggcaaagaactctacatgatttttgggatggatgccaaagccaaaatgatggttcgcaagaacagatcaaaaggatgagaatcacagactgttctgagaatccaaacattgaaggtgctagtgcaacacaaaatgctgccaatgtgaaacgtgatggtttttcagaattggagtctgctgcggatgatatagaattcatgaactcagtctcatgggaaactattgaggcagaagcaattctatcattatctcgtcgatcaacaccttcaaggatcccttcaaggatccgttggcgacaaattatgtttcagaagcgcattttctctgatgattcatttgaaatagacaagtccaaggaaaattcccttactatggatgagcagaataatctctttgaggagaacaaaatgagatttgctcaactccaagacgagtatgtcaagaccgaagcttcacttgaagcatcaaaccagcataagcaattgctttgtgaacaggtctctgatctcaagaccatgcttgatgaaaaacaaaatcaattaaaatgttgtgagttggagaccttgaagatagagactcgtcttggtgatctgaaaagaagaatgttggagacccattttacattgaaggaaagagttgaacaaacagaagaggcaaggaaacaaagtgaagaaagacaagcaaagctgcagtga

SEQ ID NO: 4591 - DNA, 2253 bp, Glycine max var. Williams 82; identical to SEQ ID NO: 2886

SEQ ID NO: 4592 - DNA, 939 bp, Glycine max var. Williams 82
atggaatcccaaacacagtctgagctaccagttgtagacttcaccaacaaaaatctgaaaccgggtactgatgcatgggtttcagcttctcaagtagtgcgtggtgcacttgaggatcatggtggtttcttggcactctatgataaggtcagtttggagacatacgactctgtttattctgaaatgatgaatttttttgacctctcaatagaaacaaaacggaggaaaaccactgaaaagcctatattcagctattctgggcaacgacctgggattcctttatatgaatctgtgggtatcatgaacccactcagctttcaggattgccagaaatacacacacgttatgtggccccaagaaaatcatcatttctgtgaaagtgtcaattcctatgcaaaacaactagtggaattggatcatattgtaaagagaatggtgtttgagagctatggactcgagacaaagaaatttgagactttacttgaatcaactgagtatgtgcttcgaggctacaaatacagaattccccgagagggtgagagcaatttgggagttgctcctcattgtgacacagctttcctaactatattgaatcagaaggtagaaggcttgggggtcaaattgaaggatgggaaatggttagaggtcggtgcttcaccctcgctatatttggtaatgggcggcgatgcattgatggtttggagtaatgacaggatacccgcttgtgaacatagagttttaatgaactcaaagatagacagatactccatgggactactttcatatgctgctaagataatggaaccacaagaggagttagttgatgaggaatatcctctacgttataaaccatttgatcattatggatatcttcgtttctttctcactgaagaggccataaaatctgattccaggatcaaagcatattgtggtatttga

SEQ ID NO: 4593 - DNA, 1941 bp, Glycine max var. Williams 82; identical to SEQ ID NO: 2982

SEQ ID NO: 4594 - DNA, 4512 bp, Glycine max var. Williams 82
atgcatgtaaggaggttcacaacgcaaagcttcttccctttgaataacgtagacgagtttgagcataaaatgaagatggagaatttttggagcatgatttgtggggattctagttgttctgagagtggaagaaagactttctgttatgatttcaatcttttgggagatccttccaaatgcttcaaccatttgttggtcatttgctttgatgtgttactacttatcatgctgtcacttaacatgatccgcaagtcttcatcgagaccattttggcctctaatccgaatgcaaagttattcaaacttgcagctagtatctgccataatcaatggtactcttggcgtgttgcatttgtgtttaggcatttggattttaggggaaaagttaaggaaaacacacactgtttttcctcttaattggtggctatcagaactctttcagggattcacatggttgttagtaggtataatcgttagtcttcacttgaaaaaactaacaagagtatggttgtggttattttctattcttatattctccgtttttggtattttatgtgctttatccatgtcttatgcaattagaagaagagaattgtccctcaaggctactttagatgttttatcatttccaggagcaattttactgctcttatgcatatacaaaatatggaaatgtgaagatactaatgaagaaattgatgaaggtctttatgctcctttaaatggccagttcaatgaagtggatcctattagctatataaccccatttgccaaagctggattctttagtaggatgtcgttttggtggctgaatccattgatgaaaaggggtcaagagaaaacacttgaagatgaggatatcccaaagttgcgggagttagatcgagcagaaacttgttacctgatgtttgtagaacaattgaacagacagaaacaaaaagaaccaccatcacagtcagttttgtggacaataattttttgccactggagagagattttgatatcagggatttttgcgttgctcaaggtgctctctcaatctgctggtcctttacttctaaatgccttcatattggttgctgaaggtaatgcaagtttcaaatatgaaggttatgtattggccatatcacttttaattacaaagatcattgaatccttatcacaaaggcagtggtatttccgcagtagacttataggaatgaaggttaagtcactcctttctacatgcatttataaaaagttactgaatttatccaatgtagcgaaattgacacactctagtggtgagataatgaattatgtgactgtggatgcttatagaattggagaacttccattttggtttcaccagacatggattacaagcatccaactatctattgcattagtaatactttatcatgctattgggctagcaacaattgcctcattggttgtgatagttctcagtgtgctttgcaatactccactagcaaagttacagcacaagtttcagacaaaactcatggtggctcaagatgagagattgaaggctagttctgaggctcttgtgaatatgaaagtgctaaaactatatgcgtgggatactcattttaaaaatgctatagaaaagttaaggaatgtggaactcaaattcttagctgcagtgcaatcaagaaaggcatacaatatatttatcttttggactgcacctattttggtctctgttgtttctttttgggcatgttacttcctgaatattcctttacatgcaaataatgttttcacttttgtggctactttacgccttgtgcaagagccaattacagccatcccagatgttgttggggctgtcattcaagcaaaagttgcttttgcccggattgttaaattcctccaagcacctgaactgcaaagtgaaaaattccaaaacaggggttttgatgatagtattcgaggctcaattttaatcaaatctgctgacttttcatgggaaggtactgcatcaaaacctacattgaggaacataaccatggaggttaaacacacgcaaaaggtggccatttgcggagaagttggctctggaaaatcaaccctcttggcaacaattctcggagaagtgcctaaaacaaagggaactattgaaatttatgggaaatttgcatatgtttctcaaacagcatggatacagacgggtacaatacgggaaaatattttgtttggatctgatttggacatgcgaagatatcaagaaacacttcatagaacttcactagttaaggacattgagctgtttccccatggtgacctcactgaaataggtgagagaggaattaacttgagtggaggtcaaaagcagcgaattcaacttgcacgtgctctttatcagaatgctgatgtatatctgttggatgatccattcagtgctgttgatgcaaatacagccacaagtttgtttaatgaatacatcatagaaggacttaaggggaagactgtcttactcgtgactcatcaagtggattttctacctgcatttgattctgttttgttaatgtcaaaaggggaaatcctacaagatgctccttatcaccaacttctgagctcaagccaagaattccaggaccttgtcaatgctcacaaggagacttctaattctaatcagtttgtgaatgctacatcttcacagagacatttaacttctgctagagagattacacaagttttcatggagaggcagtgtaaagcaacaaatggaaatcaattaattaaacaagaagagagagagaaaggagacacagggttgaagccttacctacagtatctcaatcagaggaaaagctatatatacttttgtatggttaccctttgttacactgtctttgttatttgccagatattgcaaaactcatggatggcggctaatgttgacaatccctatgtcagcacattacaattggttgttgtttacttcttgattggagttatttcaactattttcttgttgatcagatgtctagctacagttgctttgggtatgaaatcatcaaaaaaattattttcacagttaatggattcccttttttgtgcacccatgtcattttatgactctacaccattgggaaggatacttactagggtctcatcagatatgagcatcgtggatgtcgatatgcccttctaccttggttttgctgtgggaggacctataatttgttgttctaatattatagttttagcaattgtcacttggcaagtcttggttgtctctataccaatggtgtacatagcgattcacttgcagaaatgcttttttgcctctgctaaagaagtgatgcggatgaatggcacaacaaaatcctttgtagctaatcatgtttctgaaactgttgctggagttgtgacaataagggcttttgaggatgaaggtcgtttctttgagaagaatcttgatctaattgatatcaatgctagtgctttcttccatagtttttcttcaaatgaatggttgatcctacacttagaaatggtctctgcagtagttctttccttcgcagcactttgtatggttatgcttccacctggaactttcgcccctgggttcattggcatggctctctcttatggtttttcactaaatgcagccttggtatttttaattcaaagtcaatgcaatatagcaaattacataatatctgtagaaaggataaatcaatatatgcatataccaagtgaggcagaagaagtaatagaaggaaatcgtcctcctttgaattggccagatgcaggcaaagtagaaataaatgatctgcagataagatataggcctgaagggccacttgtactccatggcatcacttgcacatttgaaggagggcacaagattggtattgttggcaggacaggcagtgggaagtctactctgatcagtgctttatttcgtctcatggagccagcaagcggaaaaatcgttgttgatggcataaacatttcttctattggccttcaagatttgaggtcacgtttatgtattatacctcaggatcctactcttttcaatgggactgttagatataatttggaccctttatctcaacattctgatcaagagatatgggaggttcttggcaagtgtcaattgcaagaagtggttcaagagaaagaagagggcttaaactcctcagttgttggagagggatcaaactggagcatgggacaaagacagctgttctgtttggggcgtgccatgttgcggagaagcaaaatattggtgttggatgaagcaactgcatcaatcgataatgcaactgacatgattctgcagaaaaccattagaactgagtttgcagattgtaccgtgatcacagtggctcacaggatacctactgtgatggattgtacaatggttctttcaatcagtgaagggaatttggcggaatatgatgaaccaatgagcttgatgaggaaagaaggatcactattcaggcagcttgtcaatgaatactactctcattttcagtgtgcagaatcacattga

SEQ ID NO: 4595 - DNA, 933 bp, Glycine max var. Williams 82
atgaaaagggcaagtatgggaacattttcccaaaagcattctagcaaatatggtgttagatccattagtttgccaacaagatcacatccaagcacagttagagttgaagaggagctgagcaagcttaaatcattggaggcatcatcatctacaccaaaggtggaaacaatttgctgtggtctatctggccttgcagaattgtacaaatgcattgaagatcttttgaagttgccattgacccaacaagcactaggccagcaccaaaatgagaaatgggtcaatgagttgttggattgcccagtaggattcttggacctgttgggaaaaacaagggattccattctgttgatgaaagaaagtgttggagagcttcagagtgcacttagaaggaaaagggttggagattcggacagggagagttatctctctacatattggaggctcagaagaaacatgaggaaggagtccacaaaatctatgcttttgttgaagcagatggaaaatgagtcatttgtggcatctccaaatttggatcttagtgagcacctctctgcagtggtaagagtgctcagagaagctagtttaatcaccagctccatctttgagtcacttgttgtgttcctttcttcaccaatcttgaaactaaagcctaataagtgggcatttgttgtgtcaagattgatgcagaaggggctgttcgcttacaacaatcatcaggaaaatataaatgagttggaaaaggtggattttgcacttaacagtttgattgtggacaatctgagcaaagatgctgaggctgagaagattcaatctgcacatggaaggttagaagctttggtggtggccattgatgagattgaaaatggattggaatgcttatttaagcgcctgattaatactagagtgtcttttctgaatatattttctccttaa

SEQ ID NO: 4596 - DNA, 1326 bp, Glycine max var. Williams 82
atggaaggcatccctggcagccttggttggcctattgtgggagagagtttctcattcctctctgatttttcaaaaatcactttaagtatgtcttatgattttaatctctcaaatttatacggctgttgttttagtccctcaaataaaaatatatatggaaaggttttcaagagcttcgtccgggggaggttcactgtattcatgactgggagagaagcaagtaagattttgttaaccggaaaagatgggattgtgagtttgaatctgttttacactggccagcaagttctgggccccaccactttgctgcaaaccactggagaggcacacaaaaggctaagaaggctgatcggtgaacctttatcaattgatggactgaaaaaatatttccattttatcaatactcaggcaatggaaacattaggtcaatggcaaggaaggaaagtcctggttcttgaggaggcttctacatttactctaaaagtgattggacatatgatcatgagtttagagccttctggggaggaacaggaaaagtttaggtcaaattttaagattatctcttcctcatttgcctctttgccatttaaacttccagggacagcattccatcatggtatcaaggctcgggataggatgtatgagatgttggattctacaatttcgcggaggagaagtggccaagaatttcaacaggatttcttaggatccttagataatatattaactctgctggttgcgggccatgataccacaacagctgctcttacatggctcatcaaatttcttggtgaaaatccaattgaggaacacagacaaattgtcatcaacagaaagagtggaacagatcttacttgggctgaagttaataacatgccttacacggctaaagtgatcagtgaaacacttcgaagagccacaatactaccttggttttcaagaaaggcatcccaggattttgaaattgatggttataaaattaagaaaggttggtctgtcaacctaaatgttgtttctatacaccatgaccccgaagttttcccagatcctgaaaagtttgatccctctagatttgatgaaaccctgaggcctttcagttttcttggatttggtagtggaccacgcatgtgtcctggaatgaaccttgccaagctagaaatttgtgttttcatccatcatcttgtcaacagatacaattggagacctctggagaaagacaattctgtgcaaccaacgcttgtaaggatgccaaagaacaagtatcctattataaaactacaaacaaacaacagaagaaaagatagcacagaaaaatgttgtatatga

SEQ ID NO: 4597 - DNA, 1515 bp, Glycine max var. Williams 82
atggaacaacctccttcctcgtctcttcaggtggagacagcacaacaaccgggacctagtcctctccgaaaaatgttcgctgtctcgtcaatcgccgcgggaattcaattcgggtgggccctacagctctctcttctgacaccgtacgtccagaccctcggcgtccctcacgcatgggcgtcgttcatttggctctgcggcccaatctctgggctgcttgtgcagcccattgtagggtacagcagcgatcgatgcagatcccgcttcggtcgccgccgtcccttcatcttcgtcggagccatcgccgtcgcaattgctgtgttcctcatcggttatgcagccgatataggacacgcggcgggcgatgacctcacgaagaagacccgtccacgcgcggtggtggtctttgtggtcggcttctggatcctggacgtggccaacaacatgctccagggtccatgccgcgccttcctcggtgacctcgccgccggggaccaccgcaagacgaggaccgccaacgccttcttctcgttcttcatggccatcggaaacgtcctcggctacgcagccggctcctacgacaaactccaccgcgccttcaaattcacacaaaccgaagcgtgtgacgtgttctgtgcaaacctcaagagctgcttcttcttctcaattgtcctcctcctggttctttgtttcgttgtgctcatttgcgtcgacgacccacaattcacgccacgtggcgatgacaacaatggcgaaaacgacggcgtttcggggtcgtgctttggtgaactctgggctgcgtttaaaggtctaaagaggccaatgtggttgttgatggtagtgaccgctataaactgggtggcgtggtttccgtacatgctgttcgatactgattggatggggcgtgaggtgtacggtggtaaggtgggggagaaagcatacgattcgggagtgcataagggggcgttggggcttatgctgaactctgtcgttttggcattgatgtcgttgacggtggaaccgttgggtcgtttcgttgggggagttaagtggctatggggaatcgttaacgtaattctcgccgtttgcatggcaatgacggtggttatcacaagggctgcagaacatgaacggaaaaacggcgtttctgctgttgggcatccctcagttggtgtgcaagtggctgcattgactttcttctccgcccttggtgttcctcttgctattactttcagcgtcccctttgcactggcatctatatactcctccacttcaggagcaggccaaggtttatccttgggcgtcctcaatgttgcaattgtcgtgccacagatgatagtatcggctataagtggacagtgggataagtggtttggtggtggcaacttgccggcgtttgtgttgggtgccgtggcggccgccgtgagtgccgtgttagcggttgttctgctgccaacaccaaagccagcagatgtggccaaggttacttccgtcactgctgggagtttccattag

SEQ ID NO: 4598 - DNA, 2285 bp, Glycine max var. Williams 82; identical to SEQ ID NO: 1941

SEQ ID NO: 4599 - DNA, 2059 bp, Glycine max var. Williams 82; identical to SEQ ID NO: 1943

SEQ ID NO: 4600 - DNA, 3655 bp, Glycine max var. Williams 82; identical to SEQ ID NO: 1981

SEQ ID NO: 4601 - DNA, 2700 bp, Glycine max var. Williams 82; identical to SEQ ID NO: 2000

SEQ ID NO: 4602 - DNA, 2366 bp, Glycine max var. Williams 82; identical to SEQ ID NO: 2006

SEQ ID NO: 4603 - DNA, 3251 bp, Glycine max var. Williams 82; identical to SEQ ID NO: 2009

SEQ ID NO: 4604 - DNA, 411 bp, Glycine max var. Williams 82; identical to SEQ ID NO: 2012

SEQ ID NO: 4605 - DNA, 420 bp, Glycine max var. Williams 82; identical to SEQ ID NO: 2036

SEQ ID NO: 4606 - DNA, 1495 bp, Glycine max var. Williams 82; identical to SEQ ID NO: 3042

SEQ ID NO: 4607 - DNA, 984 bp, Glycine max var. Williams 82; identical to SEQ ID NO: 3047

SEQ ID NO: 4608 - DNA, 2175 bp, Glycine max var. Williams 82; identical to SEQ ID NO: 3049

SEQ ID NO: 4609 - DNA, 4583 bp, Glycine max var. Williams 82; identical to SEQ ID NO: 3051

SEQ ID NO: 4610 - DNA, 2226 bp, Glycine max var. Williams 82; identical to SEQ ID NO: 3082

SEQ ID NO: 4611 - DNA, 2874 bp, Glycine max var. Williams 82; identical to SEQ ID NO: 3123

SEQ ID NO: 4612 - DNA, 2979 bp, Glycine max var. Williams 82; identical to SEQ ID NO: 1802

SEQ ID NO: 4613 - DNA, 1062 bp, Glycine max var. Williams 82; identical to SEQ ID NO: 1840

SEQ ID NO: 4614 - DNA, 1076 bp, Glycine max var. Williams 82; identical to SEQ ID NO: 1849

SEQ ID NO: 4615 - DNA, 537 bp, Glycine max var. Williams 82; identical to SEQ ID NO: 1865

SEQ ID NO: 4616 - DNA, 2015 bp, Glycine max var. Williams 82; identical to SEQ ID NO: 1873

SEQ ID NO: 4617 - DNA, 852 bp, Glycine max var. Williams 82; identical to SEQ ID NO: 1880

SEQ ID NO: 4618 - DNA, 1993 bp, Glycine max var. Williams 82; identical to SEQ ID NO: 1902

SEQ ID NO: 4619 - DNA, 1486 bp, Glycine max var. Williams 82; identical to SEQ ID NO: 1910

SEQ ID NO: 4620 - DNA, 1488 bp, Glycine max var. Williams 82; identical to SEQ ID NO: 1920

SEQ ID NO: 4621 - DNA, 662 bp, Glycine max var. Williams 82; identical to SEQ ID NO: 1923

SEQ ID NO: 4622 - DNA, 2300 bp, Glycine max var. Williams 82; identical to SEQ ID NO: 938

SEQ ID NO: 4623 - DNA, 508 bp, Glycine max var. Williams 82; identical to SEQ ID NO: 979

SEQ ID NO: 4624 - DNA, 2097 bp, Glycine max var. Williams 82; identical to SEQ ID NO: 988

SEQ ID NO: 4625 - DNA, 1509 bp, Glycine max var. Williams 82; identical to SEQ ID NO: 1008

SEQ ID NO: 4626 - DNA, 1174 bp, Glycine max var. Williams 82; identical to SEQ ID NO: 1025

SEQ ID NO: 4627 - DNA, 3281 bp, Glycine max var. Williams 82; identical to SEQ ID NO: 1521

SEQ ID NO: 4628 - DNA, 1353 bp, Glycine max var. Williams 82; identical to SEQ ID NO: 1524

SEQ ID NO: 4629 - DNA, 1480 bp, Glycine max var. Williams 82; identical to SEQ ID NO: 2719

SEQ ID NO: 4630 - DNA, 1194 bp, Glycine max var. Williams 82; identical to SEQ ID NO: 2721

SEQ ID NO: 4631 - DNA, 3497 bp, Glycine max var. Williams 82; identical to SEQ ID NO: 2728

SEQ ID NO: 4632 - DNA, 2730 bp, Glycine max var. Williams 82; identical to SEQ ID NO: 2734

SEQ ID NO: 4633 - DNA, 1820 bp, Glycine max var. Williams 82; identical to SEQ ID NO: 2744

SEQ ID NO: 4634 - DNA, 2543 bp, Glycine max var. Williams 82; identical to SEQ ID NO: 2745

SEQ ID NO: 4635 - DNA, 1764 bp, Glycine max var. Williams 82; identical to SEQ ID NO: 2775

SEQ ID NO: 4636 - DNA, 1195 bp, Glycine max var. Williams 82; identical to SEQ ID NO: 2811

SEQ ID NO: 4637 - DNA, 1424 bp, Glycine max var. Williams 82; identical to SEQ ID NO: 2816

SEQ ID NO: 4638 - DNA, 1739 bp, Glycine max var. Williams 82; identical to SEQ ID NO: 2821

SEQ ID NO: 4639 - DNA, 1736 bp, Glycine max var. Williams 82; identical to SEQ ID NO: 2362

SEQ ID NO: 4640 - DNA, 1590 bp, Glycine max var. Williams 82
atggcactggaagtgcttgaagcgctcgattcagcgcgcacgcaatggtaccacgtgacggccattgttatagcgggcatgggcttcttcactgatgcctatgaccttttctgtatctcaacggtttcgaaacttttgggacggttgtactattttgacccgagcaccccaacggtgcctggaaagctcccgctgaacgtgaacaacatggtcaccggtgtcgcactcgttgggaccctcagtggccagctcgtctttggctggctcggagacaagctcggccggaaaaaagtttacggtatcaccctgatcctcatggtgttctgcgccatttgctctggactatcgttcggggcaacagcgaagtctgtcatggggacgctctgcttcttccgcttctggctcggcttcggcatcggcggagactacccgctctccgccaccatcatgtcggagtacgccaacaagcggacacgcggcgcatttatagcagccgtgttcgccatgcaaggtgtggggatcattttcgcgggtttagtctccatggccctctcaggaatctttaaatactactaccctgccccagcgtacatcgataatcctgtcttgtccacacaacccgagggtgaccttttgtggcggcttgttctcatgattggatctgtccctgcgatgttgacttactattggcgaatgaaaatgccggagacggggcgttacaccgccatcatcgaaggaaacgtgaagcaagccgccgccgacatggcgaaagtcttggacatagagatccaggctgagcaagataagttggcggaattcaatgctaacaataactacccactctggtcaaacgagttcttcaagcgacatggacgccacttgataggaacaatgagttcatggtttttgttagatattgcgttctacagccaaaacttaacgcagaaggatattttccctgcggttgggctcatacacaaagactttgaaatggacgctattagggaagtgttcgagacgtcacgtgccatgttcgtgatcgcgttgctgggaacattcccagggtattggttcactgttttcttcattgagaagattggaaggtacaagatccaacttattgggttcttcatgatgtcgttcttcatgttcatcattggggtgaagtacgattatctcaagaacgagggcaaaggctactttgcgctcttatacggattaacgttcttttttgctaactttggacccaatagcacgacgttcgtgctgcccgccgagcttttcccgacgcgcgtgagaagcacgtgtcacgcccttagcgctgcggcgggaaaagccggggccctcgtggggacattcggaatacaaagtttgactgtgggtggtcaatcatacaagattaaaaaggtgatgattattctggcggtgacaaacttgttagggttcttctcttcgtttttggttactgaaacgaagggacggtccttggaagagatttctggggaggatgggagagagagtgaactcacgccaacgcccaataataggattcagggtaggattcagggttcaaggactgagacaatgtga

SEQ ID NO: 4641 - DNA, 2561 bp, Glycine max var. Williams 82; identical to SEQ ID NO: 2385

SEQ ID NO: 4642 - DNA, 2261 bp, Glycine max var. Williams 82; identical to SEQ ID NO: 2397

SEQ ID NO: 4643 - DNA, 1438 bp, Glycine max var. Williams 82; identical to SEQ ID NO: 2406

SEQ ID NO: 4644 - DNA, 5411 bp, Glycine max var. Williams 82; identical to SEQ ID NO: 2413

SEQ ID NO: 4645 - DNA, 882 bp, Glycine max var. Williams 82; identical to SEQ ID NO: 2417

SEQ ID NO: 4646 - DNA, 1581 bp, Glycine max var. Williams 82; identical to SEQ ID NO: 2440

SEQ ID NO: 4647 - DNA, 1098 bp, Glycine max var. Williams 82; identical to SEQ ID NO: 2447

SEQ ID NO: 4648 - DNA, 941 bp, Glycine max var. Williams 82; identical to SEQ ID NO: 2450

SEQ ID NO: 4649 - DNA, 831 bp, Glycine max var. Williams 82; identical to SEQ ID NO: 2455

SEQ ID NO: 4650 - DNA, 2093 bp, Glycine max var. Williams 82; identical to SEQ ID NO: 2459

SEQ ID NO: 4651 - DNA, 1415 bp, Glycine max var. Williams 82; identical to SEQ ID NO: 2466

SEQ ID NO: 4652 - DNA, 1594 bp, Glycine max var. Williams 82; identical to SEQ ID NO: 2475

SEQ ID NO: 4653 - DNA, 2198 bp, Glycine max var. Williams 82; identical to SEQ ID NO: 2515

SEQ ID NO: 4654 - DNA, 1615 bp, Glycine max var. Williams 82; identical to SEQ ID NO: 2543

SEQ ID NO: 4655 - DNA, 7060 bp, Glycine max var. Williams 82; identical to SEQ ID NO: 2576

SEQ ID NO: 4656 - DNA, 1801 bp, Glycine max var. Williams 82; identical to SEQ ID NO: 2580

SEQ ID NO: 4657 - DNA, 1144 bp, Glycine max var. Williams 82; identical to SEQ ID NO: 2586

SEQ ID NO: 4658 - DNA, 1552 bp, Glycine max var. Williams 82; identical to SEQ ID NO: 2596

SEQ ID NO: 4659 - DNA, 2092 bp, Glycine max var. Williams 82; identical to SEQ ID NO: 612

SEQ ID NO: 4660 - DNA, 1335 bp, Glycine max var. Williams 82; identical to SEQ ID NO: 625

SEQ ID NO: 4661 - DNA, 2003 bp, Glycine max var. Williams 82; identical to SEQ ID NO: 649

SEQ ID NO: 4662 - DNA, 2542 bp, Glycine max var. Williams 82; identical to SEQ ID NO: 655

SEQ ID NO: 4663 - DNA, 940 bp, Glycine max var. Williams 82; identical to SEQ ID NO: 658

SEQ ID NO: 4664 - DNA, 1104 bp, Glycine max var. Williams 82; identical to SEQ ID NO: 670

SEQ ID NO: 4665 - DNA, 1570 bp, Glycine max var. Williams 82; identical to SEQ ID NO: 673

SEQ ID NO: 4666 - DNA, 1020 bp, Glycine max var. Williams 82; identical to SEQ ID NO: 713

SEQ ID NO: 4667 - DNA, 2032 bp, Glycine max var. Williams 82; identical to SEQ ID NO: 726

SEQ ID NO: 4668 - DNA, 1527 bp, Glycine max var. Williams 82; identical to SEQ ID NO: 736

SEQ ID NO: 4669 - DNA, 772 bp, Glycine max var. Williams 82; identical to SEQ ID NO: 742

SEQ ID NO: 4670 - DNA, 2684 bp, Glycine max var. Williams 82; identical to SEQ ID NO: 3350

SEQ ID NO: 4671 - DNA, 2703 bp, Glycine max var. Williams 82; identical to SEQ ID NO: 3376

SEQ ID NO: 4672 - DNA, 1150 bp, Glycine max var. Williams 82; identical to SEQ ID NO: 3396

SEQ ID NO: 4673 - DNA, 1975 bp, Glycine max var. Williams 82; identical to SEQ ID NO: 3428

SEQ ID NO: 4674 - DNA, 1440 bp, Glycine max var. Williams 82; identical to SEQ ID NO: 3431

SEQ ID NO: 4675 - DNA, 2184 bp, Glycine max var. Williams 82; identical to SEQ ID NO: 3438

SEQ ID NO: 4676 - DNA, 1258 bp, Glycine max var. Williams 82; identical to SEQ ID NO: 792

SEQ ID NO: 4677 - DNA, 1560 bp, Glycine max var. Williams 82; identical to SEQ ID NO: 838

SEQ ID NO: 4678 - DNA, 2709 bp, Glycine max var. Williams 82; identical to SEQ ID NO: 844

SEQ ID NO: 4679 - DNA, 2288 bp, Glycine max var. Williams 82; identical to SEQ ID NO: 852

SEQ ID NO: 4680 - DNA, 1597 bp, Glycine max var. Williams 82; identical to SEQ ID NO: 863

SEQ ID NO: 4681 - DNA, 1636 bp, Glycine max var. Williams 82; identical to SEQ ID NO: 865

SEQ ID NO: 4682 - DNA, 1467 bp, Glycine max var. Williams 82; identical to SEQ ID NO: 866

SEQ ID NO: 4683 - DNA, 573 bp, Glycine max var. Williams 82; identical to SEQ ID NO: 875

SEQ ID NO: 4684 - DNA, 1638 bp, Glycine max var. Williams 82; identical to SEQ ID NO: 882

SEQ ID NO: 4685 - DNA, 1053 bp, Glycine max var. Williams 82; identical to SEQ ID NO: 918

SEQ ID NO: 4686 - DNA, 1804 bp, Glycine max var. Williams 82; identical to SEQ ID NO: 3451

SEQ ID NO: 4687 - DNA, 3455 bp, Glycine max var. Williams 82; identical to SEQ ID NO: 3460

SEQ ID NO: 4688 - DNA, 1129 bp, Glycine max var. Williams 82; identical to SEQ ID NO: 3468

SEQ ID NO: 4689 - DNA, 1452 bp, Glycine max var. Williams 82; identical to SEQ ID NO: 3471

SEQ ID NO: 4690 - DNA, 1480 bp, Glycine max var. Williams 82; identical to SEQ ID NO: 3474

SEQ ID NO: 4691 - DNA, 1105 bp, Glycine max var. Williams 82; identical to SEQ ID NO: 3485

SEQ ID NO: 4692 - DNA, 624 bp, Glycine max var. Williams 82; identical to SEQ ID NO: 3497

SEQ ID NO: 4693 - DNA, 1252 bp, Glycine max var. Williams 82; identical to SEQ ID NO: 3500

SEQ ID NO: 4694 - DNA, 507 bp, Glycine max var. Williams 82; identical to SEQ ID NO: 3536

SEQ ID NO: 4695 - DNA, 711 bp, Glycine max var. Williams 82; identical to SEQ ID NO: 3543

SEQ ID NO: 4696 - DNA, 1706 bp, Glycine max var. Williams 82; identical to SEQ ID NO: 1078

SEQ ID NO: 4697 - DNA, 2070 bp, Glycine max var. Williams 82; identical to SEQ ID NO: 1102

SEQ ID NO: 4698 - DNA, 997 bp, Glycine max var. Williams 82; identical to SEQ ID NO: 1106

SEQ ID NO: 4699 - DNA, 1096 bp, Glycine max var. Williams 82; identical to SEQ ID NO: 1127

SEQ ID NO: 4700 - DNA, 689 bp, Glycine max var. Williams 82; identical to SEQ ID NO: 1137

SEQ ID NO: 4701 - DNA, 2971 bp, Glycine max var. Williams 82; identical to SEQ ID NO: 1152

SEQ ID NO: 4702 - DNA, 3184 bp, Glycine max var. Williams 82; identical to SEQ ID NO: 1153

SEQ ID NO: 4703 - DNA, 3111 bp, Glycine max var. Williams 82; identical to SEQ ID NO: 1154

SEQ ID NO: 4704 - DNA, 1785 bp, Glycine max var. Williams 82; identical to SEQ ID NO: 1159

SEQ ID NO: 4705 - DNA, 1956 bp, Glycine max var. Williams 82; identical to SEQ ID NO: 1188

SEQ ID NO: 4706 - DNA, 4559 bp, Glycine max var. Williams 82; identical to SEQ ID NO: 1204

SEQ ID NO: 4707 - DNA, 1397 bp, Glycine max var. Williams 82; identical to SEQ ID NO: 1214

SEQ ID NO: 4708 - DNA, 2612 bp, Glycine max var. Williams 82; identical to SEQ ID NO: 1216

SEQ ID NO: 4709 - DNA, 2226 bp, Glycine max var. Williams 82; identical to SEQ ID NO: 2101

SEQ ID NO: 4710 - DNA, 1494 bp, Glycine max var. Williams 82; identical to SEQ ID NO: 2139

SEQ ID NO: 4711 - DNA, 1703 bp, Glycine max var. Williams 82; identical to SEQ ID NO: 2154

SEQ ID NO: 4712 - DNA, 3259 bp, Glycine max var. Williams 82; identical to SEQ ID NO: 2156

SEQ ID NO: 4713 - DNA, 2426 bp, Glycine max var. Williams 82; identical to SEQ ID NO: 2206

SEQ ID NO: 4714 - DNA, 2754 bp, Glycine max var. Williams 82; identical to SEQ ID NO: 2222

SEQ ID NO: 4715 - DNA, 1414 bp, Glycine max var. Williams 82; identical to SEQ ID NO: 2231

SEQ ID NO: 4716 - DNA, 709 bp, Glycine max var. Williams 82; identical to SEQ ID NO: 2233

SEQ ID NO: 4717 - DNA, 1813 bp, Glycine max var. Williams 82; identical to SEQ ID NO: 2244

SEQ ID NO: 4718 - DNA, 2291 bp, Glycine max var. Williams 82; identical to SEQ ID NO: 2243

SEQ ID NO: 4719 - DNA, 1371 bp, Glycine max var. Williams 82; identical to SEQ ID NO: 2603

SEQ ID NO: 4720 - DNA, 2581 bp, Glycine max var. Williams 82; identical to SEQ ID NO: 2640

SEQ ID NO: 4721 - DNA, 1122 bp, Glycine max var. Williams 82; identical to SEQ ID NO: 2656

SEQ ID NO: 4722 - DNA, 813 bp, Glycine max var. Williams 82; identical to SEQ ID NO: 2671

SEQ ID NO: 4723 - DNA, 2079 bp, Glycine max var. Williams 82
gagaatcaggtcaagacgtggaaactggaatgctatcttatcctggataacatttcaactacttactcccactcttcagtcatacaaactcaaaatcacaatggccttctcatcgtccatatggtcttcttccatctttgttcccaacccaaacagaaccaccatttccactcgattctctcacacaccctccaaaccccctctctcgccggcattcgccattccgccgctctccacggccaccgccacggacgtctcgggcgtcatcgacgggacgacgatcgcggtggtcagcggggggttcgtggcggcacttgcggcggtgctgtcgctgacggaccccgagcggcggcggcaaatgcaagcggaggaggtgggcggcggcgacaaggaggtggtgagggagtacttcaacaactccgggttccagcgctggaagaagatctatggagacaccgacgaggtgaaccgggttcagcgcgacattaggttgggtcacgccaagaccgtggagaacacgctgagcatgttgaaggacgaagggtcccttcagggaattacggtttgcgacgctgggtgcggtacgggctcgctctctattcctcttgctaaagagggcgctgttgtgttcgccagtgatatctccgccgctatggttgctgaagcagagaaacaggcaaaagaacagcttgtaaccagtgaagatggttccgggcctgtgatgccaaagtttgtagtgaaggatttggagagcttagatggcaagtatgacacggtggtctgccttgatgttttgattcattacccccaaagtaaagctgatgggatgattgcacaccttgcatcattggccaacaagcgattgattctgagttttgccccaaagacgttttattatgatctgctaaagagggttggagagttgttccctggtccttcaaaggcaacaagggcatatcttcactccgaggcagatgtagagagagcattgcaaaaggttggctggaccataaggaagagaggcttaaccactactcaattttactttgctaggcttattgaggctgttcctatgtagtggggattgaaaggtgagttttgtataattagaggaaattcttagtgtaaattgtaaggccttctattaaatgattttgtatgctattattctcccacatggaccgcatataattctattgtgtatatttcttcgtagcgtagaatatgctgacgaattgaggctatgttttcttggggaaatagactgaagtggttcataataaatttgtgtggagctagtgagttggcggtccattgggttggtggaatggaggcaagctccctataagttgttcagacgttacaacgcttattactcaagctgcatctagagtagaaagaataaacatcaaccacatgaaaacaaataatatgaagagtagtattccccaaaaaatgaggtaaaaagctgagaagtactaatttaaaagaggaaaaaaatgatgatgatgaaatctagtgcctaattaagttctttcatttgtcttttgatgtgaattcatttatagcttgtcagcaatttttgtaagagcatctgtgagcttgccaagggctgcaactataatatcagtttgctgcttctgctggtccctggccaattggtaatttatgttctgagtcccaatatgagcttttagtatgtcactgttcctccttagtagtttggtaatgttgttgaaatctgtgctgtcctcactaatgtccgatgataaccgctttctcttgtatcccattccctcctggaatataggttccctctgaatgcctgaaccaaaatatactttacatgagattgtgaaaaaaggccaattatgttggaatcgaattcggtgcagtctacttttcgtgtattcacgcaatcaatgaatcataatcaatagatgaagattggacaactcaaatctcaaaatgttttataaccaatttgggtgtgtttgaaaaacgttgggttcaatgtgtaacccatgttttttaatttttccaatccaacatatagttacttttcagtttgccgctttg

SEQ ID NO: 4724 - DNA, 4447 bp, Glycine max var. Williams 82; identical to SEQ ID NO: 1553

SEQ ID NO: 4725 - DNA, 1894 bp, Glycine max var. Williams 82; identical to SEQ ID NO: 1555

SEQ ID NO: 4726 - DNA, 1569 bp, Glycine max var. Williams 82; identical to SEQ ID NO: 1565

SEQ ID NO: 4727 - DNA, 2385 bp, Glycine max var. Williams 82; identical to SEQ ID NO: 1568

SEQ ID NO: 4728 - DNA, 2001 bp, Glycine max var. Williams 82; identical to SEQ ID NO: 1579

SEQ ID NO: 4729 - DNA, 1557 bp, Glycine max var. Williams 82; identical to SEQ ID NO: 1599

SEQ ID NO: 4730 - DNA, 3442 bp, Glycine max var. Williams 82; identical to SEQ ID NO: 1611

SEQ ID NO: 4731 - DNA, 1563 bp, Glycine max var. Williams 82; identical to SEQ ID NO: 1659

SEQ ID NO: 4732 - DNA, 662 bp, Glycine max var. Williams 82; identical to SEQ ID NO: 1661

SEQ ID NO: 4733 - DNA, 4872 bp, Glycine max var. Williams 82; identical to SEQ ID NO: 1679

SEQ ID NO: 4734 - DNA, 1420 bp, Glycine max var. Williams 82; identical to SEQ ID NO: 1685

SEQ ID NO: 4735 - DNA, 2253 bp, Glycine max var. Williams 82
ctcaggtcctaattatttactgcattaacttaatcgacatactttgaattcgtcgatgcatatagttcgctattctttggcttctccaccaccatcactcttcttctctttctcctctgccatggctttcttcacctatgcttcaaactctaaccaatgcccaaaacaaaccttgttgttcatattcaccatcttcaccttgttccatacactctttaccactgtagagtgcctttccttcaacttttcaaccttccaaccaaactcaaataatctaatagactttaaaggtgatgctttttcctcacgcggtgttcttcagctcacaaagaaccaaattgatgacaaaatcacattcagcgttggtcgagcctcgtataaccaacaagtgaggctttgggatagaagaactaagaaactcactgatttcacaacccatttctcttttgtcatgaaagctgttgaccctaaacggtttggggatgggctagccttcttcattgcaccctttgattctgttattcccaacaattcagctggtgggtaccttggcctattcagcaatgaatccgcattcaacatgaagaaaaatcagttagttgcggttgagttcgacagcttcgaaaacgaatgggatccgagctctgatcatgttgggatcgatgtcaactccattcaatccgttacaaatgtctcttggaagagcagcattaagaacggatcggtcgctaatgcttggatatggtacaactctacaaccaaaaatctctctgtgttccttacttatgctgataatccaacttttaatggcaattctagtctttcttatgtcattgatttgagggacgtgttgccagagcttgttagaataggcttttctgctgccacgggttcgtggattgaagtgcacaacattttgtcttggtcattcagttcaaacttggatggggataataggaaaaaggttaaggttggtttagtggttggtttaagtgttggtttgggttgttgtttagtttgtgttgtaggcctattatggtttaccttttggagaagaaaaaataaaggaaaggaggaaaacttaggtgttgatgcttctatagatgatgagtttgagagaggaactggtccaaagaggttcacctatcgcgaactaagcaatgcaaccaacaactttgcagaagaaggaaagctaggagaaggaggatttggaggtgtttacaaaggcttagttgtgaactcaaaccttgaagtggcagtgaagagggtttcaaaagggtcaaaacaagggaaaaaggaatatgtatcagaagtgagagtaatcagcaggctaaggcatagaaacttggttcaactcatagggtggtgccatgaacaaggtgagctccttcttgtttatgaatacatgcctaatggaagccttgattctcatatatttggaaatagagtcatgctttcatgggtggtgagacacaaggtggctttaggtttggcatctgctcttctttatcttcatgaagagtgggaacaatgtgtggtgcatagagacattaagtcaagtaatgtcatgttggatgcaaatttcaatgctaaacttggtgacttcggtcttgcaaggctagtagaccatgaacttggttctcaaaccactgttttggcaggcacaatgggatacctagccccggaatgtgtcaccacagggaaatctagcaaagagagtgatgtgtacagctttggtgttgttgcacttgaaatcacatgtggtagaaaaccagtggaagttagagaagagcctagtaaagtaaggcttgtggagtgggtgtggagcctctatggaaaagggaaactacttgaagcagctgataagaaactgaattgggaatttgaagaacagcaaatggaatgtttgatgattgtggggttgtggtgttgccatcctgatcataccatgaggccatccattaggcaagtgattagtgtccttaaccttgaagcccctttgccaagtcttccatccaagttgcctgtgccaatgtattatgcacctccaatggatatgtgcaaattctcctacacttcatctggtgttacaagcacaaccaaagaatcttctccatactcttcaatgtcagctgggtccggaaaatctctattgtagcacttaatattcagatatttgaattgtactgtggcataacttgttttattttgtttgagcagcagaatatgcacatcatctcttgttgaatgcac

SEQ ID NO: 4736 - DNA, 1473 bp, Glycine max var. Williams 82; identical to SEQ ID NO: 1737

SEQ ID NO: 4737 - DNA, 1787 bp, Glycine max var. Williams 82; identical to SEQ ID NO: 1750

SEQ ID NO: 4738 - DNA, 1539 bp, Glycine max var. Williams 82; identical to SEQ ID NO: 1751

SEQ ID NO: 4739 - DNA, 1860 bp, Glycine max var. Williams 82; identical to SEQ ID NO: 493

SEQ ID NO: 4740 - DNA, 2079 bp, Glycine max var. Williams 82; identical to SEQ ID NO: 514

SEQ ID NO: 4741 - DNA, 2996 bp, Glycine max var. Williams 82; identical to SEQ ID NO: 524

SEQ ID NO: 4742 - DNA, 1971 bp, Glycine max var. Williams 82; identical to SEQ ID NO: 543

SEQ ID NO: 4743 - DNA, 904 bp, Glycine max var. Williams 82; identical to SEQ ID NO: 2260

SEQ ID NO: 4744 - DNA, 1748 bp, Glycine max var. Williams 82; identical to SEQ ID NO: 2261

SEQ ID NO: 4745 - DNA, 624 bp, Glycine max var. Williams 82; identical to SEQ ID NO: 2295

SEQ ID NO: 4746 - DNA, 624 bp, Glycine max var. Williams 82; identical to SEQ ID NO: 2295

SEQ ID NO: 4747 - DNA, 1014 bp, Glycine max var. Williams 82; identical to SEQ ID NO: 2308

SEQ ID NO: 4748 - DNA, 624 bp, Glycine max var. Williams 82; identical to SEQ ID NO: 2327

SEQ ID NO: 4749 - DNA, 522 bp, Glycine max var. Williams 82; identical to SEQ ID NO: 2328

SEQ ID NO: 4750 - DNA, 411 bp, Glycine max var. Williams 82; identical to SEQ ID NO: 2340

SEQ ID NO: 4751 - DNA, 669 bp, Glycine max var. Williams 82; identical to SEQ ID NO: 2345

SEQ ID NO: 4752 - DNA, 3364 bp, Glycine max var. Williams 82; identical to SEQ ID NO: 2356

SEQ ID NO: 4753 - DNA, 3554 bp, Glycine max var. Williams 82; identical to SEQ ID NO: 2357

SEQ ID NO: 4754 - DNA, 1448 bp, Glycine max var. Williams 82; identical to SEQ ID NO: 1256

SEQ ID NO: 4755 - DNA, 2205 bp, Glycine max var. Williams 82; identical to SEQ ID NO: 1291

SEQ ID NO: 4756 - DNA, 3892 bp, Glycine max var. Williams 82; identical to SEQ ID NO: 1304

SEQ ID NO: 4757 - DNA, 1329 bp, Glycine max var. Williams 82; identical to SEQ ID NO: 1351

SEQ ID NO: 4758 - DNA, 1239 bp, Glycine max var. Williams 82; identical to SEQ ID NO: 1352

SEQ ID NO: 4759 - DNA, 1830 bp, Glycine max var. Williams 82; identical to SEQ ID NO: 1388

SEQ ID NO: 4760 - DNA, 1584 bp, Glycine max var. Williams 82; identical to SEQ ID NO: 1393

SEQ ID NO: 4761 - DNA, 1875 bp, Glycine max var. Williams 82; identical to SEQ ID NO: 3151

SEQ ID NO: 4762 - DNA, 1179 bp, Glycine max var. Williams 82; identical to SEQ ID NO: 3159

SEQ ID NO: 4763 - DNA, 3744 bp, Glycine max var. Williams 82; identical to SEQ ID NO: 3161

SEQ ID NO: 4764 - DNA, 2284 bp, Glycine max var. Williams 82; identical to SEQ ID NO: 3165

SEQ ID NO: 4765 - DNA, 1324 bp, Glycine max var. Williams 82; identical to SEQ ID NO: 3180

SEQ ID NO: 4766 - DNA, 2493 bp, Glycine max var. Williams 82; identical to SEQ ID NO: 3224

SEQ ID NO: 4767 - DNA, 2397 bp, Glycine max var. Williams 82; identical to SEQ ID NO: 3225

SEQ ID NO: 4768 - DNA, 1029 bp, Glycine max var. Williams 82; identical to SEQ ID NO: 3262

SEQ ID NO: 4769 - DNA, 1539 bp, Glycine max var. Williams 82; identical to SEQ ID NO: 3273

SEQ ID NO: 4770 - DNA, 1006 bp, Glycine max var. Williams 82; identical to SEQ ID NO: 3287

SEQ ID NO: 4771 - DNA, 1059 bp, Glycine max var. Williams 82; identical to SEQ ID NO: 2880

SEQ ID NO: 4772 - DNA, 2253 bp, Glycine max var. Williams 82; identical to SEQ ID NO: 2886

SEQ ID NO: 4773 - DNA, 2262 bp, Glycine max var. Williams 82; identical to SEQ ID NO: 2890

SEQ ID NO: 4774 - DNA, 3179 bp, Glycine max var. Williams 82; identical to SEQ ID NO: 2913

SEQ ID NO: 4775 - DNA, 994 bp, Glycine max var. Williams 82; identical to SEQ ID NO: 2921

SEQ ID NO: 4776 - DNA, 1341 bp, Glycine max var. Williams 82; identical to SEQ ID NO: 2958

SEQ ID NO: 4777 - DNA, 1955 bp, Glycine max var. Williams 82; identical to SEQ ID NO: 2968

SEQ ID NO: 4778 - DNA, 1602 bp, Glycine max var. Williams 82; identical to SEQ ID NO: 2971

SEQ ID NO: 4779 - DNA, 1222 bp, Glycine max var. Williams 82; identical to SEQ ID NO: 2974
